United States Patent
Franklin et al.

(10) Patent No.: US 8,633,012 B2
(45) Date of Patent: Jan. 21, 2014

(54) TAILORED OILS PRODUCED FROM RECOMBINANT OLEAGINOUS MICROORGANISMS

(71) Applicant: Solazyme, Inc., South San Francisco, CA (US)

(72) Inventors: Scott Franklin, La Jolla, CA (US); Aravind Somanchi, Redwood City, CA (US); Janice Wee, San Mateo, CA (US); George Rudenko, Mountain View, CA (US); Jeffrey L. Moseley, Redwood City, CA (US); Walt Rakitsky, San Diego, CA (US); Xinhua Zhao, Foster City, CA (US); Riyaz Bhat, South San Francisco, CA (US)

(73) Assignee: Solazyme, Inc., South San Francisco, CA (US)

( * ) Notice: Subject to any disclaimer, the term of this patent is extended or adjusted under 35 U.S.C. 154(b) by 0 days.

(21) Appl. No.: 13/650,024

(22) Filed: Oct. 11, 2012

(65) Prior Publication Data

US 2013/0034887 A1 Feb. 7, 2013

Related U.S. Application Data

(63) Continuation of application No. 13/365,253, filed on Feb. 2, 2012.

(60) Provisional application No. 61/438,969, filed on Feb. 2, 2011, provisional application No. 61/476,691, filed on Apr. 18, 2011, provisional application No. 61/484,458, filed on May 10, 2011, provisional application No. 61/548,616, filed on Oct. 18, 2011.

(51) Int. Cl.
| | | |
|---|---|---|
| C12N 1/13 | (2006.01) | |
| C12N 1/12 | (2006.01) | |
| C12P 7/64 | (2006.01) | |
| C12N 15/56 | (2006.01) | |
| C12N 9/18 | (2006.01) | |
| C07H 21/04 | (2006.01) | |

(52) U.S. Cl.
USPC .................. 435/257.2; 435/134; 435/257.1; 435/201; 435/197; 536/24.5

(58) Field of Classification Search
None
See application file for complete search history.

(56) References Cited

U.S. PATENT DOCUMENTS

| | | |
|---|---|---|
| 3,280,502 A | 10/1966 | Farrow et al. |
| 3,957,578 A | 5/1976 | Narita et al. |
| 4,341,038 A | 7/1982 | Bloch et al. |
| 4,390,561 A | 6/1983 | Blair et al. |
| 4,519,845 A | 5/1985 | Ou |
| 4,755,467 A | 7/1988 | Scopes et al. |
| 5,130,242 A | 7/1992 | Barclay |
| 5,212,087 A | 5/1993 | Fournier et al. |
| 5,270,177 A | 12/1993 | Ramos Lazcano et al. |
| 5,304,481 A | 4/1994 | Davies et al. |
| 5,338,673 A | 8/1994 | Thepenier et al. |
| 5,436,394 A | 7/1995 | Willmitzer et al. |
| 5,455,167 A | 10/1995 | Voelker et al. |
| 5,492,938 A | 2/1996 | Kyle et al. |
| 5,518,918 A | 5/1996 | Barclay |
| 5,547,699 A | 8/1996 | Lizuka et al. |
| 5,595,965 A | 1/1997 | Wiggins |
| 5,597,400 A | 1/1997 | Nonomura et al. |
| 5,711,983 A | 1/1998 | Kyle et al. |
| 5,792,631 A | 8/1998 | Running |
| 5,900,370 A | 5/1999 | Running |
| 5,968,791 A | 10/1999 | Davies et al. |
| 6,139,897 A | 10/2000 | Goto et al. |
| 6,255,505 B1 | 7/2001 | Bijl et al. |
| 6,338,866 B1 | 1/2002 | Criggall et al. |
| 6,410,281 B1 | 6/2002 | Barclay |
| 6,441,208 B2 | 8/2002 | Bijl et al. |
| 6,620,427 B2 | 9/2003 | Lasekan et al. |
| 7,053,267 B2 | 5/2006 | Knauf et al. |
| 7,268,276 B2 | 9/2007 | Ruezinsky et al. |
| 7,309,602 B2 | 12/2007 | David |
| 7,622,570 B2 | 11/2009 | Oswald et al. |
| 7,879,591 B2 | 2/2011 | Damude et al. |

(Continued)

FOREIGN PATENT DOCUMENTS

| | | |
|---|---|---|
| CN | 101037639 A | 9/2007 |
| JP | 06-253872 A | 9/1994 |

(Continued)

OTHER PUBLICATIONS

Radakovits et al Apr. 2010 Eukaryotic Cell p. 486-501.*

(Continued)

*Primary Examiner* — David T Fox
*Assistant Examiner* — Matthew Keogh
(74) *Attorney, Agent, or Firm* — Alston & Bird LLP

(57) ABSTRACT

Methods and compositions for the production of oil, fuels, oleochemicals, and other compounds in recombinant microorganisms are provided, including oil-bearing microorganisms and methods of low cost cultivation of such microorganisms. Microalgal cells containing exogenous genes encoding, for example, a lipase, a sucrose transporter, a sucrose invertase, a fructokinase, a polysaccharide-degrading enzyme, a keto acyl-ACP synthase enzyme, a fatty acyl-ACP thioesterase, a fatty acyl-CoA/aldehyde reductase, a fatty acyl-CoA reductase, a fatty aldehyde reductase, a fatty acid hydroxylase, a desaturase enzyme, a fatty aldehyde decarbonylase, and/or an acyl carrier protein are useful in manufacturing transportation fuels such as renewable diesel, biodiesel, and renewable jet fuel, as well as oleochemicals such as functional fluids, surfactants, soaps and lubricants.

30 Claims, 3 Drawing Sheets

(56) References Cited

U.S. PATENT DOCUMENTS

| | | |
|---|---|---|
| 7,883,882 B2 | 2/2011 | Franklin et al. |
| 7,935,515 B2 | 5/2011 | Franklin et al. |
| 7,939,710 B1 | 5/2011 | Apt et al. |
| 8,029,579 B2 | 10/2011 | Knuth et al. |
| 8,119,583 B2 | 2/2012 | Day et al. |
| 8,187,860 B2 | 5/2012 | Franklin et al. |
| 8,222,010 B2 | 7/2012 | Franklin et al. |
| 8,268,610 B2 | 9/2012 | Franklin et al. |
| 8,278,261 B2 | 10/2012 | Day et al. |
| 8,283,483 B2 | 10/2012 | Williams et al. |
| 2002/0178467 A1 | 11/2002 | Dehesh |
| 2003/0082595 A1 | 5/2003 | Jiang et al. |
| 2003/0097686 A1 | 5/2003 | Knauf et al. |
| 2003/0145350 A1 | 7/2003 | Spener et al. |
| 2003/0211594 A1 | 11/2003 | Rosebrook |
| 2005/0005333 A1 | 1/2005 | Ruezinsky et al. |
| 2005/0102716 A1 | 5/2005 | Venkatramesh et al. |
| 2005/0262588 A1 | 11/2005 | Dehesh et al. |
| 2005/0266537 A1 | 12/2005 | Chen |
| 2006/0094089 A1 | 5/2006 | Barclay |
| 2006/0130182 A1 | 6/2006 | Heim et al. |
| 2006/0156436 A1 | 7/2006 | Nakamura et al. |
| 2007/0099280 A1 | 5/2007 | Barclay |
| 2007/0167396 A1 | 7/2007 | Dillon et al. |
| 2007/0261138 A1 | 11/2007 | Graham et al. |
| 2007/0275438 A1 | 11/2007 | David |
| 2008/0160593 A1 | 7/2008 | Oyler |
| 2008/0206379 A1 | 8/2008 | Fabritius et al. |
| 2008/0283803 A1 | 11/2008 | Rapp et al. |
| 2009/0004715 A1 | 1/2009 | Trimbur et al. |
| 2009/0011480 A1 | 1/2009 | Trimbur et al. |
| 2009/0035842 A1 | 2/2009 | Trimbur et al. |
| 2009/0047721 A1 | 2/2009 | Trimbur et al. |
| 2009/0061493 A1 | 3/2009 | Trimbur et al. |
| 2009/0099260 A1 | 4/2009 | Namal Senanayake et al. |
| 2009/0148918 A1 | 6/2009 | Trimbur et al. |
| 2009/0176272 A1 | 7/2009 | Champagne et al. |
| 2009/0234146 A1 | 9/2009 | Cooney et al. |
| 2009/0274736 A1 | 11/2009 | Dillon et al. |
| 2009/0317878 A1 | 12/2009 | Champagne et al. |
| 2010/0021912 A1 | 1/2010 | Farese et al. |
| 2010/0058651 A1 | 3/2010 | Knuth et al. |
| 2010/0105955 A1 | 4/2010 | Alibhai et al. |
| 2010/0151112 A1 | 6/2010 | Franklin et al. |
| 2010/0151538 A1 | 6/2010 | Franklin et al. |
| 2010/0154293 A1 | 6/2010 | Hom et al. |
| 2010/0170144 A1 | 7/2010 | Day et al. |
| 2010/0186117 A1 | 7/2010 | Fabijanski et al. |
| 2010/0196575 A1 | 8/2010 | Sanchez et al. |
| 2010/0239712 A1 | 9/2010 | Brooks et al. |
| 2010/0297292 A1 | 11/2010 | Brooks et al. |
| 2010/0297295 A1 | 11/2010 | Brooks et al. |
| 2010/0297296 A1 | 11/2010 | Brooks et al. |
| 2010/0297323 A1 | 11/2010 | Brooks et al. |
| 2010/0297325 A1 | 11/2010 | Brooks et al. |
| 2010/0297331 A1 | 11/2010 | Brooks et al. |
| 2010/0303957 A1 | 12/2010 | Brooks et al. |
| 2010/0303961 A1 | 12/2010 | Brooks et al. |
| 2010/0303989 A1 | 12/2010 | Brooks et al. |
| 2010/0303990 A1 | 12/2010 | Brooks et al. |
| 2010/0323413 A1 | 12/2010 | Trimbur et al. |
| 2010/0323414 A1 | 12/2010 | Trimbur et al. |
| 2011/0014665 A1 | 1/2011 | Trimbur et al. |
| 2011/0015417 A1 | 1/2011 | Trimbur et al. |
| 2011/0047863 A1 | 3/2011 | Trimbur et al. |
| 2011/0072714 A1 | 3/2011 | Gaertner |
| 2011/0190522 A1 | 8/2011 | Trimbur et al. |
| 2011/0203168 A1 | 8/2011 | Franklin et al. |
| 2011/0252696 A1 | 10/2011 | Franklin et al. |
| 2011/0256268 A1 | 10/2011 | Franklin et al. |
| 2011/0256282 A1 | 10/2011 | Piechocki et al. |
| 2011/0293785 A1 | 12/2011 | Franklin et al. |
| 2011/0294174 A1 | 12/2011 | Franklin et al. |
| 2012/0009636 A1 | 1/2012 | Berry et al. |
| 2012/0028319 A1 | 2/2012 | Trimbur et al. |
| 2012/0034662 A1 | 2/2012 | Hu et al. |
| 2012/0119862 A1 | 5/2012 | Franklin et al. |
| 2012/0122192 A1 | 5/2012 | Trimbur et al. |
| 2012/0128851 A1 | 5/2012 | Brooks et al. |
| 2012/0164701 A1 | 6/2012 | Trimbur et al. |
| 2012/0203018 A1 | 8/2012 | Franklin et al. |
| 2012/0277452 A1 | 11/2012 | Franklin et al. |
| 2012/0277453 A1 | 11/2012 | Franklin et al. |
| 2012/0283460 A1 | 11/2012 | Franklin et al. |
| 2012/0288930 A1 | 11/2012 | Trimbur et al. |
| 2012/0324784 A1 | 12/2012 | Franklin et al. |
| 2012/0329109 A1 | 12/2012 | Chua et al. |
| 2013/0004646 A1 | 1/2013 | Franklin et al. |
| 2013/0005005 A1 | 1/2013 | Day et al. |
| 2013/0006006 A1 | 1/2013 | Day et al. |
| 2013/0031678 A1 | 1/2013 | Zheng et al. |
| 2013/0078709 A1 | 3/2013 | Franklin et al. |
| 2013/0089916 A1 | 4/2013 | Franklin et al. |
| 2013/0096211 A1 | 4/2013 | Franklin et al. |
| 2013/0102039 A1 | 4/2013 | Franklin et al. |
| 2013/0165677 A1 | 6/2013 | Franklin et al. |

FOREIGN PATENT DOCUMENTS

| | | |
|---|---|---|
| JP | 2003-102467 A | 4/2003 |
| WO | WO 92/11373 A1 | 7/1992 |
| WO | WO 94/10288 A2 | 5/1994 |
| WO | WO 95/13390 A2 | 5/1995 |
| WO | WO 99/37166 A1 | 7/1999 |
| WO | WO 00/61740 A1 | 10/2000 |
| WO | WO 02/08403 A2 | 1/2002 |
| WO | WO 2007/038566 | 4/2007 |
| WO | WO 2007/117511 A2 | 10/2007 |
| WO | WO 2007/134294 A2 | 11/2007 |
| WO | WO 2008/002643 A2 | 1/2008 |
| WO | WO 2008/083352 A1 | 7/2008 |
| WO | WO 2008/130372 A2 | 10/2008 |
| WO | WO 2008/134866 A2 | 11/2008 |
| WO | WO 2008/151149 A2 | 12/2008 |
| WO | WO 2009/126843 A2 | 10/2009 |
| WO | WO 2010/019813 A2 | 2/2010 |
| WO | WO 2010/045368 A2 | 4/2010 |
| WO | WO 2010/063031 A2 | 6/2010 |
| WO | WO 2010/063032 A2 | 6/2010 |
| WO | WO 2010/111698 A2 | 9/2010 |
| WO | WO 2010/120923 A1 | 10/2010 |
| WO | WO 2010/120939 A2 | 10/2010 |
| WO | WO 2011/090730 A1 | 7/2011 |
| WO | WO 2011/130573 A1 | 10/2011 |
| WO | WO 2011/130576 A1 | 10/2011 |
| WO | WO 2011/130578 A2 | 10/2011 |
| WO | WO 2011/150410 A2 | 12/2011 |
| WO | WO 2011/150411 A1 | 12/2011 |
| WO | WO 2012/061647 A2 | 5/2012 |
| WO | WO 2012/106560 A1 | 8/2012 |
| WO | WO 2012/154626 A1 | 11/2012 |

OTHER PUBLICATIONS

Rismani-Yazdi et al 2011 BMC Genomics 12:148 p. 1-17.*
Moreno-Perez et al 2012 Planta 235: p. 629-639.*
Guiry 2012 Journal of Phycology 48: p. 1057-1063.*
"Enzymatic Assay of Invertase (EC 3.2.1.26)," Sigma-Aldrich Co. LLC., (1999). [Retrieved from the Internet Aug. 21, 2012: < http://www.sigmaaldrich.com/etc/medialib/docs/Sigma/General_Information/invertase_temp_25.Par.0001.File.tmp/invertase_temp_25.pdf.
Abate et al., "Production of ethanol by a flocculent *Saccharomyces* sp. in a continuous upflow reactor using sucrose, sugar-cane juice, and molasses as the carbon source," MIRCEN Journal, 3:401-409, (1987).
Aggelis et al., "Enhancement of single cell oil production by Yarrowia lipolytica growing in the presence of *Teucrium polium* L. aqueous extract," Biotechnology Letters, 21:747-749, (1999).
Alberto et al., "Crystal structure of inactivated *Thermotoga maritima* invertase in complex with the trisaccharide substrate raffinose," Biochem. J., 395:457-462 (2006).

(56) References Cited

OTHER PUBLICATIONS

Bergh et al., "Expression of the *Saccharomyces cerevisiae* glycoprotein invertase in mouse fibroblasts: Glycosylation, secretion, and enzymatic activity," Proc. Natl. Acad. Sci. USA, 84:3570-3574, (1987).
Bigogno et al., "Biosynthesis of arachidonic acid in the oleaginous microalga *Parietochloris incisa* (Cholorphyceae): Radiolabeling studies," Lipids 37(2):209-216 (2002); Abstract Only.
Bonaventure et al., "Disruption of the FATB Gene in *Arabidopsis* Dethonstrates an Essential Role of Saturated Fatty Acids in Plant Growth " The Plant Cell 15:1020-1033, (2003).
Borza et al., "Multiple Metabolic Roles for the Nonphotosynthetic Plastid of the Green Alga *Prototheca wickerhamii*," Eukaryotic Cell, 4(2):253-261, (2005).
Brown et al., "The amino-acid and sugar composition of 16 species of micralgae used in mariculture," J. Exp. Mar. Biol. Ecol. 145:79-99 abstract (1991).
Canam, "An Investigation of the Physiological Roles and Enzymatic Properties of Invertases in Tobacco and Hybrid Poplar," Thomas Benjamin Canam, 165 pages, (2008).
Carlson et al., "The Secreted Form of Invertase in *Saccharomyces cerevisiae* is Synthesized from mRNA Encoding a Signal Sequence," Molecular and Cellular Biology,3(3):439-447, (1983).
Chasan, "Engineering Fatty Acids—The Long and Short of It," Plant Cell, 7:235-237, (1995).
Chen et al., "High cell density culture of microalgae in heterotrophic growth," Trends in Biotechnology, 14:421-426, (1996).
Cheng et al., "Sugars modulate an unusual mode of control of the cell-wall invertase gene (Incw1) through its 3' untranslated region in a cell suspension culture of *maize*," Proc. Natl. Acad. Sci. USA, 96:10512-10517, (1999 ).
Cho et al., "Molecular cloning and expression analysis of the cell-wall invertase gene family in rice (*Oryza sativa* L.)," Plant Cell Rep , 24:225-236 , (2005).
Courchesne et al., "Enhancement of Lipid Production Using Biochemical, Genetic and Transcription Factor Engineering Approaches," J Biotechnol. Epub, 141(1-2):31-41, (2009).
De Coninck et al., "*Arabidopsis* AtcwINV3 and 6 are not invertases but are fructan exohydrolases (FEHs) with different substrate specificities," Plant, Cell and Environment , 28,:432-443, (2005).
Dehesh et al., "KAS IV: a 3-ketoacyl-ACP synthase from *Cuphea* sp. is a medium chain specific condensing enzyme," The Plant Journal, 15:383-390, (1998).
Dehesh et al., "Production of high levels of 8:0 and 10:0 fatty acids in transgenic canola by overexpression of Ch FatB2, a thioesterase cDNA from *Cuphea hookeriana*," The Plant Journal, 9(2):167-172, (1996).
Dimou et al., "Genes coding for a putative cell-wall invertase and two putative monosaccharide/H+ transporters are expressed in roots of etiolated Glycine max seedlings," Plant Science , 169:798-804, (2005).
Dormann et al., "Cloning and Expression in *Escherichia coli* of a Novel Thioesterase from *Arabidopsis thaliana* Specific for Long-Chain Acyl-Acyl Carrier Proteins," Archives of Biochemistry and Biophysics, 316(1):612-618, 1995.
Dunahay et al., "Genetic Engineering of Microalgae for Fuel Production," Applied Biochemistry and Biotechnology, 34/35:331-339 (1992).
Dunahay et al., "Manipulation of Microalgal Lipid Production Using Genetic Engineering," Applied Biochemistry and Biotechnology, 57/58:223-231, (1996).
Eccleston et al., "Medium-chain Fatty Acid Biosynthesis and Utilization in *Brassica mapus* Plants Expressing Lauroyl-Acyl Carrier Protein Thioesterase," Planta 198:46-53, (1996).
Ehneβ et al., "Co-ordinated induction of mRNAs for extracellular invertase and a glucose transporter in *Chenopodium rubrum* by cytokinins,"The Plant Journal , 11(3):539-548, (1997).
El-Fadaly et al., "Single Cell Oil Production by an Oleaginous Yeast Strain in a Low Cost Cultivation Medium," Research Journal of Microbiology, 4(8):301-313, (2009).

European Search Report and European Search Opinion for application EP08769988 mailed Jul. 1, 2011.
European Search Report and European Search Opinion for application EP11158642 mailed Jul. 1, 2011.
Evans et al., "A comparison of the oleaginous yeast, *Candida curvata*, grown on different carbon sources in continuous and batch culture," Lipids, 18(09):623-629, (1983).
Facciotti et al., "Improved stearate phenotype in transgenic canola expressing a modified acyl-acyl carrier protein thioesterase ," Nat Biotechnol., 17(6):593-597, (1999).
Fall et al., "Bioconversion of Xylan to Triglycerides by Oil-Rich Yeasts," Applied and Environmental Microbiology, 47(5):1130-1134, (1984).
Ferrentino, "Microalgal oil extraction and in situ transesterification," University of New Hampshire, Pub. No. MT 1447885, 93 pages, (2007).
Ferrentino, et al., "Microalgal Oil Extraction and In-situ Transesterification," AIChE Annual Mtg, San Francisco, CA, Nov. 11-13, 2006. Abstract.
Florencio et al., "A factorial approach for a sugarcane juice-based low cost culture medium: increasing the astaxanthin production by the red yeast *Phaffia rhodozyma*," Bioprocess Engineering, 19:161-164, (1998).
Forster et al., "Citric acid production from sucrose using a recombinant strain of the yeast *Yarrowia lipolyticae*," Appl Microbiol Biotechnol, 75:1409-1417 , (2007).
Foyer et al., "Sucrose and Invertase, an Uneasy Alliance," Iger Innovations, pp. 18-21, (1997).
Gallagher et al., "Isolation and characterization of a cDNA clone from *Lolium temulentum* L. encoding for a sucrose hydrolytic enzyme which shows alkaline/neutral invertase activity'," Journal of Experimental Bota, 49(322.):789-795, (1998).
Gascon et al., "Comparative Study of the Properties of the Purified Internal and External Invertases from Yeast," The Journal of Biological Chemistry, 243(7):1573-1577, (1968).
Gill et al., "Lipid Accumulation in an Oleaginous Yeast (Candida 107) Growing on Glucose in Single-Stage Continuous Culture," Applied and Environmental Microbiology, 33(02):231-239, (1977).
Godt et al., "Regulation and Tissue-Specific Distribution of mRNAs for Three Extracellular Invertase Isoenzymes of Tomato Suggests an Important Function in Establishing and Maintaining Sink Metabolism'," Plant Physiol, 115:273-282, (1997).
Goetz et al., "The different pH optima and substrate specificities of extracellular and vacuolar invertases from plants are determined by a single amino-acid substitution," The Plant Journal, 20(6):707-711, (1999).
Grinna et al., "Size Distribution and General Structual Features of N-Linked Oligosaccharides from the Methylotrophic Yeast, *Pichia pastoris*," Yeast, 5:107-115, (1989).
Gul et al., "Sterols and the Phytosterol Content in Oilseed Rape (*Brassica napus* L.)," Journal of Cell and Molecular Biology, 5:71-79 (2006).
Hajirezaeil et al., "Impact of elevated cytosolic and apoplastic invertase activity on carbon metabolism during potato tuber development," Journal of Experimental Botany, GMP Special Issue, 51:439-445, (2000).
Hall et al., "Lipid Accumulation in an Oleaginous Yeast (Candida 107) Growing on Glucose Under Various Conditions in a One- and Two-Stage Continuous Culture," Applied and Environmental Microbiology, 33(3):577-584, (1977).
Heise et al., "Factors Controlling Medium-Chain Fatty Acid Synthesis in Plastids From Cuphea Embryos," Prog. Lipid Res., 33(1/2):87-95, (1994).
Henderson et al., "Lipid Composition and Biosynthesis in the Marine Dinoflagellate *Crypthecodznzum cohnii*" Phytochem. 27(6):1679-1683 (1988).
Heredia et al., "Simultaneous utilization of glucose and xylose by Candida curvata D in continuous culture," Biotechnology Letters, 10(01):25-30, (1988).
Hong et al., "Engineering *Yarrowia lipolytica* to express secretory invertase with strong FBAIIN promoter," Yeast, 29:59-72, (2012). Published online Dec. 29, 2011 in Wiley Online Library (wileyonlinelibrary.com).

(56) References Cited

OTHER PUBLICATIONS

Hossain et al., "The effect of the sugar source on citric acid production by *Aspergillus niger*," Appl Microbiol Biotechnol, 19:393-397, (1984).
Husic et al., "Effect of Osmotic Stress on Carbon Metabolism in *Chlangdomonas reinhardtii*," Plant Physioi., 82:594-596, (1986).
Jaworski et al., "Industrial oils from transgenic plants," Current Opinion in Plant Biology, 6:178-184, (2003).
Jha et al., "Cloning and functional expression of an acyl-ACP thioesterase FatB type from *Diploknema* (*madhuca*) *butyracea* seeds in *Escherichia coli*," Plant Physiology and Biochemistry, 44:645-655, (2006).
Ji et al., "The rice genome encodes two vacuolar invertases with fructan exohydrolase activity but lacks the related fructan biosynthesis genes of the Pooideae," New Phytologist, 173:50-62, (2007).
Katayama et al., "Alpha-Linolenate and Photosynethetic Activity in *Chlorella* Protothecoides," Plant Physiol., 42:308-313, (1967).
Kenyon, "Fatty Acid Composition of Unicellular Strains of Blue-Green Algae," J. Bacteriology 109(2):827-834 (1972).
Kern et al., "Stability, quaternary structure, and folding of internal, external, and core-glycosylated invertase from yeast," Protein Sci., 1:120-131, (1992).
Kessler et al., "Physiological and Biochemical Contributions to the Taxonomy of the Genus *Prototheca III*. Utilization of Organic Carbon and Nitrogen Compounds," Arch Microbiol, 132:103-106, (1982).
Kong et al., "Microbial production of lipids by cofermentation of glucose and xylose with *Lipomyces starkeyi* 2#," Chinese Journal of Bioprocess Engineering, 05(02):36, (2007).
Lalonde et al., "The Dual Function of Sugar Carriers: Transport and Sugar Sensing," The Plant Cell 11:707-726, (1996).
Lammens et al., "*Arabidopsis thaliana* cell wall invertase in complex with ligands," HASYLAB, Annual Report 2006, Part II, Scientific User Contributions Part II, Protein Crystallography at EMBL Beamlines, pp. 61-62, (2006). [Retrieved from the Internet Aug.
Lara et al., "Extracellular Invertase is an Essential Component of Cytokinin-Mediated Delay of Senescence," The Plant Cell, 16:1276-1287, (2004).
Le Roy et al., "Unraveling the Difference between Invertases and Fructan Exohydrolases: A Single Amino Acid (Asp-239) Substitution Transforms *Arabidopsis* Cell Wall Invertasel into a Fructan 1-Exohydrolase," Plant Physiology, 145:616-625, (2007).
Li et al., "DNA variation at the invertase locus invGE/GF is associated with tuber quality traits in populations of potato breeding clones," Genetics, 40 pages, (2005). Published on Mar. 31, 2005 as 10.1534/genetics.104.040006.
Li et al., "High-density cultivation of oleaginous yeast *Rhodosporidium toruloides* Y4 in fed-batch culture," Enzyme and Microbial Technology, 41:312-317, (2007).
Li et al., "Screening of oleaginous yeasts for broad-spectrum carbohydrates assimilating capacity," China Biotechnology, 25(12):39-44, and machine translation.
Liras et al., "Biosynthesis and Secretion of Yeast Invertase Effect of Cycloheximide and 2-Deoxy-D-glucose," Eur. J. Biochem., 23:160-165, (1971).
Lubitz, "The Protein Quality, Digestibility, and Composition of Algae, *Chlorella* 71105," J. Food Sci. 28(2):229-232 (1963).
Matsuka et al., Plant and Cell Physiol., 7:149-162 (1966).
Mayer et al., A Structural Model of the Plant Acyl-Acyl Carrier Protein Thioesterase FatB Comprises Two Helix/4-Stranded Sheet Domains, the N-terminal Domain Containing Residues That Affect Specificity and the C-terminal Domain Containing Catalytic Resid.
Mayer et al., "Identification of amino acid residues involved in substrate specificity of plant acyl-ACP thioesterases using a bioinformatics-guided approach," BMC Plant Biology, 7(1):1-11, (2007).
Meesters et al., "High-cell-density cultivation of the lipid accumulating yeast *Cryptococcus curvatus* using glycerol as a carbon source," Applied Microbiology and Biotechnology, 45:575-579, (1996).

Mekhedov et al., "Toward a Functional Catalog of the Plant Genome. A Survey of Genes for Lipid Biosynthesis," Plant Physiology, 122:389-401, (2000).
Meng et al., "Biodiesel production from oleaginous microorganisms," Renewable Energy, 34:1-5, (2009).
Miao et al., "High Yield Bio-Oil Production from Fast Pyrolysis by Metabolic Controlling of *Chlorella protothecoides*," J. Biotech., 110:85-93, (2004).
Mitsljhashi et al., "Differential Expression of Acid Invertase Genes during Seed Germination in *Arabidopsis thaliana*," Biosci. Biotechnol. Biochem, 68(3):602-608, (2004).
Morris, "Effect of Growth Temperature on the Cryopreservation of *Prototheca*," Journal of General Microbiology, 94:395-399, (1976).
Murakami et al., "Lipid Composition of Commercial Bakers' Yeasts Having Different Freeze-tolerance in Frozen Dough," Biosci. Biotechnol. Biochem., 60(11)1874-1876, (1996).
Neigeborn et al., "Genes Affecting the Regulation of Suc2 Gene Expression by Glucose Repression in *Saccharomyces cerevisiae*," Genetics, 108:845-858, (1984).
Neigeborn et al., "Mutations Causing Constitutive Invertase Synthesis in Yeast: Genetic Interactions with snf Mutations," Genetics, 115:247-253, (1987).
Neish et al., "Carbohydrate Nutrition of *Cholorella vulgaris*," Canadian Journal of Botany, 29:68-78, (1951).
Nguyen-Quoc et al., "A role for 'futile cycles' involving invertase and sucrose synthase in sucrose metabolism of tomato fruit," Journal of Experimental Botany, 52(358):881-889, (2001).
O'Mullan et al., "Purification and some properties of extracellular invertase B from *Zymomonas rrtobiris*," Appl Microbiol Biotechnol, 38:341-346, (1992).
Otles et al., "Fatty Acid Composition of *Chlorella* and Spirulina Microalgae Species," Journal of AOAC International, 84(6):1708-1714, (2001).
Pagny et al., "Fusion with HDEL Protects Cell Wall Invertase from Early Degradation when N-glycosylation is Inhibited," Plant Cell Physiol., 44(2)173-182 , (2003).
Papanikolaou et al., "Lipid production by *Yarrowia lipolytica* growing on industrial glycerol in a single-stage continuous culture," Bioresource Technology, 82:43-49, (2002).
Patil et al., "Fatty acid composition of 12 microalgae for possible use in aquaculture feed," Aquacult Int , 15:1-9, (2007).
PCT International Preliminary Report on Patentability (Chapter I) of May 31, 2011 for application PCT/US09/066142.
PCT International Preliminary Report on Patentability (Chapter I) of Aug. 13, 2012 for application PCT/US11/38463.
PCT International Preliminary Report on Patentability (Chapter I) of Dec. 7, 2009 for application PCT/US08/65563.
PCT International Search Report for application PCT/US2011/032582 mailed Aug. 9, 2011.
PCT International Search Report for application PCT/US2011/038463 mailed Jan. 18, 2012.
PCT International Search Report for application PCT/US2012/023696 mailed May 23, 2012.
PCT International Search Report for application PCT/US2012/036690 mailed Aug. 30, 2012.
PCT International Search Report of Aug. 20, 2010 for application PCT/US2009/066142.
PCT International Search Report of Nov. 5, 2010 for application PCT/US2009/066141.
PCT International Search Report of Nov. 6, 2008 for application PCT/US08/65563.
PCT Written Opinion of the International Search Authority of Aug. 20, 2010 for application PCT/US2009/066142.
PCT Written Opinion of the International Searching Authority for application PCT/US2011/032582 mailed Aug. 9, 2011.
PCT Written Opinion of the International Searching Authority for application PCT/US2011/038463 mailed Jan. 18, 2012.
PCT Written Opinion of the International Searching Authority for application PCT/US2012/023696 mailed May 23, 2012.
PCT Written Opinion of the International Searching Authority for application PCT/US2012/036690 mailed Aug. 30, 2012.
PCT Written Opinion of the International Searching Authority of Nov. 5, 2010 for application PCT/US2009/066141.

(56) References Cited

OTHER PUBLICATIONS

PCT Written Opinion of the International Searching Authority of Nov. 6, 2008 for application PCT/US08/65563.
Perlman et al., "Mutations affecting the signal sequence alter synthesis and secretion of yeast invertase," Proc. Natl. Acad. Sci. USA, 83:5033-5037, (1986).
Petkov et al., "Which are fatty acids of the green alga *Chlorella*?," Biochemical Systematics and Ecology, 35:281-285, (2007).
Pons et al., "Three Acidic Residues Are at the Active Site of a β-Propeller Architecture in Glycoside Hydrolase Families 32, 43, 62, and 68," Proteins: Structure, Function, and Bioinformatics, 54:424-432, (2004).
Powell et al., "Algae Feeding in Humans," J. Nutrition, 75:7-12, (1961).
Proels et al., "Novel mode of hormone induction of tandem tomato invertase genes in floral tissues," Plant Molecular Bioingy, 52:191-201, (2003).
Ratledge, "Regulation of lipid accumulation in oleaginous microorganisms," Biochem Soc Trans., 30(Pt 6)1047-1050, 2002.
Reddy et al., "Characterization of the Glycosylation Sites in Yeast External inver," The Journal of Biological Chemistry, 263(15):6978-6955, (1988).
Rehm et al., "Heterologous expression of the acyl-acyl carrier protein thioesterase gene from the plant *Umbellularia californica* mediates polyhydroxyalkanoate biosynthesis in recombinant *Escherichia coli*," Appl Microbiol Biotechnol, 55:205-209, (2001).
Riesmeier et al., "Potato Sucrose Transporter Expression in Minor Veins Indicates a Role in Phloem Loading," The Plant Cell, 5:1591-1598, (1993).
Ritsema et al., "Engineering fructan metabolism in plants," J. Plant Physiol., 160:811-820, (2003).
Roig et al., "*Candida albicans* UBI3 and 11814 promoter regions confer differential regulation of invertase production to *Saccharomyces cerevisiae* cells in response to stress," Int Microbiol, 5:33-36, (2002).
Roitsch et al., "Expression of yeast invertase in oocytes from *Xenopus laevis*," Eur. J. Biochem, 181:733-739, (1989).
Roitsch et al., "Extracellular invertase: key metabolic enzyme and PR protein," Journal of Experimental Botany, Regulation of Carbon Metabolism Special Issue, 54(382):513-524, (2003).
Roitsch et al., "Function and regulation of plant invertases: sweet sensations," Trends in Plant Science, .9(12):606-613, (2004).
Roitsch et al., "Induction of Apoplastic Invertase of *Chenopodium rubrum* by ID-Glucose and a Glucose Analog and Tissue-Specific Expression Suggest a Role in Sink-Source Regulation," Plant Physiol.,108:285-294, (1995).
Rosenberg et al., "A Green Light for Engineered Algae: Redirecting Metabolism to Fuel a Biotechnology Revolution," Current Opinion in Biotechnology. Tissue, Cell and Pathyway Engineering, E-Pub 19:430-436, (2008).
Roy et al., "Production of Intracellular Fat by the Yeast *Lipomyces starkeyi*," Indian Journal of Experimental Biology, 16(4):511-512, (1978).
Salou et al., "Growth and Energetics of *Leuconostoc oenos* during Cometabolism of Glucose with Citrate or Fructose," Applied and Environmental Microbiology, 60(5):1459-1466, (1994).
Schütt et al., "The role of acyl carrier protein isoforms from *Cuphea lanceolata* seeds in the de-novo biosynthesis of medium-chain fatty acids," Publication, Planta, 205:263-268, (1998).
Sergeeva et al., "Vacuolar invertase regulates elongationof *Arabidopsis thaliana* roots as revealed by QTL and mutant analysis," PNAS, 103(8):2994-2999, (2006).
Sherson et al., "Roles of cell-wall invertases and monosaccharide transporters in the growth and development of *Arabidopsis*," Journal of Experimental Botany, 54(382):525-531, (2003).
Simpson et al., "Requirements for mini-exon inclusion in potato invertase mRNAs provides evidence for exon-scanning interactions in plants," RNA, 6:422-433, (2000).

Sinha et al., "Metabolizable and Non-Metabolizable Sugars Activate Different Signal Transduction Pathways in Tomato," Plant Physiology, 128:1480-1489, (2002).
Sitthiwong et al., "Changes in Carbohydrate Content and the Activities of Acid Invertase, Sucrose Synthase and Sucrose Phosphate Synthase in Vegetable Soybean During Fruit Development," Asian Journal of Plant Sciences, 4(6):684-690, (2005).
Sonnewald et al., "Transgenic tobacco plants expressing yeast-derived invertase in either the cytosol, vacuole or apoplast: a powerful tool for studying sucrose metabolism and sink/source interactions," The Plant Journal, 1(1):95-106, (1991).
Spolaore et al., "Commercial Applications of Microalgae," J. Biosci. Bioeng. 101(2):87-96 (2006).
Sud et al., "Lipid Composition and Sensitivity of *Prototheca wickerhamii* to Membrane-Active Antimicrobial Agents," Antimicrobial Agents and Chemotherapy, 16:486-490, (1979).
Suh et al., "What limits production of unusual monoenoic fatty acids in transgenic plants?," Planta, 215:584-595, (2002).
Takashima et al., "Further Notes on the Growth and Chlorophyll Formation of *Chlorella protothecoides*," Plant & Cell Physiol., 5:321-332, (1964).
Thavarungkul et al., "Batch injection analysis for the determination of sucrose in sugar cane juice using immobilized invertase and thermometric detection," Biosensors & Bioelectronics, 14:19-25, (1999).
Thiry et al., "Optimizing scale-up fermentation processes," Trends in Biotechnology, 20:103-105, (2002).
Tornabene et al., "Lipid composition of the nitrogen starved green alga *Neochloris oleoabundans*," Enzyme Microb. Technol., 5:435-440, (1983).
Trimble et al., "Structure of Oligosaccharides on Saccharomyces SUC2 Invertase Secreted by the Methylotrophic Yeast *Pichia pastoris*," J. Biol. Chem., 266(34):22807-22817, (1991).
Trimble et al., "Structure of oligosaccharides on Saccharomyces SUC2 Invertase Secreted by the Methylotrophic Yeast *Pichia pastoris*," The Journal of Biological Chemistry, 266(34):22807-22817, (1991).
Tymowska-Lalanne et al., "Expression of the *Arabidopsis thaliana* invertase gene family," Planta 207: 259-265, (1998).
U.S. Appl. No. 12/131,766, Advisory Action mailed Oct. 13, 2011.
U.S. Appl. No. 12/131,766, Non-Final Office Action mailed Aug. 1, 2011.
U.S. Appl. No. 12/131,766, Non-Final Office Action mailed Nov. 23, 2010.
U.S. Appl. No. 12/131,766, Non-Final Office Action mailed Dec. 10, 2009.
U.S. Appl. No. 12/131,766, Requirement for Restriction/Election mailed Aug. 5, 2009.
U.S. Appl. No. 12/131,766, Requirement for Restriction/Election mailed Aug. 17, 2010.
U.S. Appl. No. 12/131,773, Final Office Action mailed Mar. 21, 2011.
U.S. Appl. No. 12/131,773, Non-Final Office Action mailed Jun. 25, 2010.
U.S. Appl. No. 12/131,773, Non-Final Office Action mailed Dec. 15, 2009.
U.S. Appl. No. 12/131,773, Requirement for Restriction/Election mailed Aug. 6, 2009.
U.S. Appl. No. 12/131,783, Final Office Action mailed Jan. 12, 2012.
U.S. Appl. No. 12/131,783, Non-Final Office Action mailed Jun. 6, 2011.
U.S. Appl. No. 12/131,783, Requirement for Restriction/Election mailed Apr. 19, 2011.
U.S. Appl. No. 12/131,793, Final Office Action mailed Mar. 30, 2010.
U.S. Appl. No. 12/131,793, Non-Final Office Action mailed Apr. 3, 2013.
U.S. Appl. No. 12/131,793, Non-Final Office Action mailed Jun. 21, 2012.
U.S. Appl. No. 12/131,793, Non-Final Office Action mailed Sep. 16, 2009.
U.S. Appl. No. 12/131,793, Non-Final Office Action mailed Nov. 13, 2012.
U.S. Appl. No. 12/131,793, Requirement for Restriction/Election mailed Aug. 6, 2009.

(56) References Cited

OTHER PUBLICATIONS

U.S. Appl. No. 12/131,804, Final Office Action mailed Feb. 2, 2011.
U.S. Appl. No. 12/131,804, Non-Final Office Action mailed Oct. 26, 2012.
U.S. Appl. No. 12/131,804, Non-Final Office Action mailed Mar. 3, 2010.
U.S. Appl. No. 12/131,804, Non-Final Office Action mailed Jun. 7, 2012.
U.S. Appl. No. 12/131,804, Requirement for Restriction/Election mailed Sep. 17, 2009.
U.S. Appl. No. 12/131,804, Requirement for Restriction/Election mailed Nov. 18, 2009.
U.S. Appl. No. 12/194,389, Final Office Action mailed Jan. 5, 2011.
U.S. Appl. No. 12/194,389, Non-Final Office Action mailed Feb. 4, 2010.
U.S. Appl. No. 12/194,389, Requirement for Restriction/Election mailed Oct. 5, 2010.
U.S. Appl. No. 12/194,389, Requirement for Restriction/Election mailed Nov. 2, 2009.
U.S. Appl. No. 12/628,140, Final Office Action mailed Mar. 15, 2013.
U.S. Appl. No. 12/628,140, Non-Final Office Action mailed Oct. 30, 2012.
U.S. Appl. No. 12/628,144, Final Office Action mailed Nov. 16, 2010.
U.S. Appl. No. 12/628,144, Final Office Action mailed Dec. 5, 2011.
U.S. Appl. No. 12/628,144, Non-Final Office Action mailed Jun. 7, 2011.
U.S. Appl. No. 12/628,144, Non-Final Office Action mailed Jul. 8, 2010.
U.S. Appl. No. 12/628,147, Examiner Interview Summary Record mailed Mar. 3, 2011.
U.S. Appl. No. 12/628,147, Final Office Action mailed Jul. 12, 2012.
U.S. Appl. No. 12/628,147, Final Office Action mailed Oct. 1, 2010.
U.S. Appl. No. 12/628,147, Non-Final Office Action mailed May 25, 2010.
U.S. Appl. No. 12/628,147, Non-Final Office Action mailed Oct. 25, 2011.
U.S. Appl. No. 12/628,149, Non-Final Office Action mailed Jun. 25, 2010.
U.S. Appl. No. 12/628,149, Non-Final Office Action mailed Sep. 16, 2010.
U.S. Appl. No. 12/628,149, Notice of Allowance mailed Dec. 15, 2010.
U.S. Appl. No. 12/628,150, Non-Final Office Action mailed Apr. 29, 2010.
U.S. Application No. 12/628,150, Non-Final Office Action mailed Oct. 13, 2010.
U.S. Appl. No. 12/628,150, Notice of Allowance mailed Mar. 21, 2011.
U.S. Appl. No. 12/772,163, Non-Final Office Action mailed May 25, 2012.
U.S. Appl. No. 12/772,163, Non-Final Office Action mailed Dec. 12, 2012.
U.S. Appl. No. 12/772,163, Requirement for Restriction/Election mailed Jun. 24, 2011.
U.S. Appl. No. 12/772,164, Final Office Action mailed May 24, 2012.
U.S. Appl. No. 12/772,164, Non-Final Office Action mailed Oct. 12, 2011.
U.S. Appl. No. 12/772,164, Requirement for Restriction/Election mailed Jul. 20, 2011.
U.S. Appl. No. 12/772,170, Final Office Action mailed Feb. 21, 2012.
U.S. Appl. No. 12/772,170, Non-Final Office Action mailed Sep. 13, 2011.
U.S. Appl. No. 12/772,170, Requirement for Restriction/Election mailed Jul. 13, 2011.
U.S. Appl. No. 12/772,173, Final Office Action mailed May 7, 2012.
U.S. Appl. No. 12/772,173, Non-Final Office Action mailed Dec. 16, 2011.
U.S. Appl. No. 12/772,173, Requirement for Restriction/Election mailed Oct. 26, 2011.
U.S. Appl. No. 12/772,174, Non-Final Office Action mailed Nov. 29, 2011.
U.S. Appl. No. 12/772,174, Requirement for Restriction/Election mailed Aug. 10, 2011.
U.S. Appl. No. 12/960,388, Requirement for Restriction/Election mailed Apr. 1, 2013.
U.S. Appl. No. 12/981,409, Non-Final Office Action mailed Jan. 6, 2012.
U.S. Appl. No. 12/981,409, Notice of Allowance mailed May 29, 2012.
U.S. Appl. No. 12/981,409, Requirement for Restriction/Election mailed Apr. 19, 2012.
U.S. Appl. No. 12/981,409, Requirement for Restriction/Election mailed Oct. 28, 2011.
U.S. Appl. No. 13/029,061, Requirement for Restriction/Election mailed Nov. 29, 2011.
U.S. Appl. No. 13/045,500, Non-Final Office Action mailed Mar. 9, 2012.
U.S. Appl. No. 13/045,500, Final Office Action mailed Sep. 26, 2012.
U.S. App. No. 13/073,757, Non-Final Office Action mailed Aug. 15, 2011.
U.S. Appl. No. 13/073,757, Non-Final Office Action mailed Dec. 29, 2011.
U.S. Appl. No. 13/073,757, Notice of Allowance mailed Apr. 17, 2012.
U.S. Appl. No. 13/118,365, Non-Final Office Action mailed Feb. 11, 2013.
U.S. Appl. No. 13/118,365, Requirement for Restriction/Election mailed Oct. 11, 2012.
U.S. Appl. No. 13/406,417, Non-Final Office Action mailed Nov. 5, 2012.
U.S. Appl. No. 13/406,417, Requirement for Restriction/Election mailed Apr. 30, 2012.
U.S. Appl. No. 13/479,200, Requirement for Restriction/Election mailed Jan. 15, 2013.
U.S. Appl. No. 13/543,666, Requirement for Restriction/Election mailed Jan. 3, 2013.
U.S. Appl. No. 13/550,412, Non-Final Office Action mailed Oct. 29, 2012.
U.S. Appl. No. 13/550,412, Notice of Allowance mailed Feb. 21, 2013.
U.S. Appl. No. 13/558,252, Non-Final Office Action mailed Jan. 18, 2013.
U.S. Appl. No. 13/601,928, Non-Final Office Action mailed Jan. 31, 2013.
U.S. Appl. No. 13/601,928, Notice of Allowance mailed Feb. 26, 2013.
U.S. Appl. No. 13/621,722, Requirement for Restriction/Election mailed Jan. 31, 2013.
U.S. Appl. No. 13/628,039, Requirement for Restriction/Election mailed Mar. 7, 2013.
U.S. Appl. No. 12/772,173, Non-Final Office Action mailed Mar. 29, 2013.
U.S. Appl. No. 12/628,147, Notice of Allowance and Examiner Initiated Interview Summary mailed Aug. 7, 2012.
Voegele et al., "Cloning and Characterization of a Novel Invertase from the Obligate Biotroph *Uromyces fabae* and Analysis of Expression Patterns of Host and Pathogen Invertases in the Course of Infection," Molecular Plant Microbe Interactions, 19 625-634.
Voelker et al., "Alteration of the Specificity and Regulation of Fatty Acid Synthesis of *Escherichia coli* by Expression of a Plant Medium Chain Acyl-Acyl Carrier Protein Thioesterase," Journal of Bacteriology, 176(23):7320-7327, (1994).
Voelker et al., "Broad-Range and Binary-Range Acyl-Acyl-Carrier-Protein Thioesterases Suggest an Alternative Mechanism for Medium-Chain Production in Seeds," Plant Physiol., 114:669-677, (1997).
Voetz et al., "Three Different cDNAs Encoding Acyl Carrier Proteins from *Cuphea lanceolata*'," Plant Physiol., 106:785-786, (1994).
Warner et al., "Analysis of Tocopherols and Phytosterols in Vegetable Oils by HPLC with Evaporative Light-Scattering Detection," JAOCS, 67(11):827-831 (1990).

(56) References Cited

OTHER PUBLICATIONS

Weber et al., "Invertases and life beyond sucrose cleavage," Trends in Plant Science, 5(2):47-48, (2000).
Wiberg et al., "The distribution of caprylate, caprate and laurate in lipids from developing and mature seeds of transgenic *Brassica napus* L.," Planta, 212:33-40, (2000).
Wu et al., "A Comparative Study of Gases Generated from Simulant Thermal Degradation of Autotrophic and Heterotrophic *Chlorella*," Progress in Natural Science, 2(4):311-318, (1992).
Wu et al., "Comparative study on Liposoluble Compounds in Autotrophic and Heterotrophic *Chlorella* Protothecoides," Acta Botanica Sinica, 35(11):849-858, (1992).
Wu et al., "New Discoveries in Study on Hydrocarbons From Thermal Degradation of Heterotrophically Yellowing Algae," Science in China, 37(3):326-35, (1994).
Yanase et al., "Expression of the Extracellular Levansucrase and Invertase Genes from *Zymomonas mobilis* in *Escherichia coli* Cells," Biosci, Biotechnol. Biochem., 62(9):1802-1805, (1998).
Yu et al., "Modifications of the metabolic pathways of lipid and triacylglycerol production in microalgae," Microbial Cell Factories, 10:91, (2011). [Retrieved from the Internet Jul. 24, 2012: <URL: http://www.microbialcellfactories.com/content/10/1/91>].
Yuan et al., "Modification of the substrate specificity of an acyl-acyl carrier protein thioesterase by protein engineering," Proc. NatL Acad. Sci. USA, Biochemistry, 92:10639-10643, (1995).
Zárate et al., "Characterization of the heterologous invertase produced by *Schizosaccharomyces pombe* from the SUC2 gene of *Saccharomyces cerevisiae*," Journal of Applied Bacteriology, 80:45-52, (1996).
Zarowska et al., "Production of Citric Acid on Sugar Beet Molasses by Single and Mixed Cultures of *Yarrowia lipolytica*," Electronic Journal of Polish Agricultural Universities, 4(2):1-7, (2001). [Retrieved from the Internet Oct. 3, 2011: <URL: http://.
Zhang et al., "Cloning and Characterization of an Invertase Gene From the Garden Pea (*Pisum sativum* L)," Jiesheng Zhang, M.S. Plant Biology Thesis, 82 pages, (2003).
Zhao et al., "Medium optimization for lipid production through cofermentation of glucose and xylose by the oleaginous yeast *Lipomyces starkeyi*," Eur. J. Lipid Sci. Technol., 110:405-412, (2008).
"Soybean Oil Innovations, 3rd Edition," United Soybean Board, www.soyconnection.com, 8 pages, (2009). [Available from the Internet on Jan. 15, 2009: <URL: http://www.soyconnection.com/sites/default/files/soy-oil-solutions.pdf>].
"Codex Standard for Named Vegtable Oils," CODEX Alimentarius, CODEX STAN 210-1999, pp. 1-16, (1999).
Barnes et al., "Contribution of 5'- and 3'-untranslated regions of plastid mRNAs to the expression of *Chlamydomonas reinhardtii* chloroplast genes," Mol Genet Geonomics, 247(6):625-636, (2005).
Blowers et al., "Studies on *Chlarnydomonas chloroplast* transformation: foreign DNA can be stably maintained in the chromosome," Plant Cell, 1(1):123-132,(1989).
Bornscheuer et al. (ed), "Enzymes in Lipid Modification," Wiley-VCH Verlag Gmbh & Co. KGaA, 1st Edition, ISBN: 3-527-30176-3, Sections 1-11, 231 pages, (2000). (part 1 of 2 of book)
Bornscheuer et al. (ed), "Enzymes in Lipid Modification," Wiley-VCH Verlag Gmbh & Co. KGaA, 1st Edition, ISBN: 3-527-30176-3, Sections 12-18, 133 pages, (2000), (part 2 of 2 of book).
Chen et al., "Heterotophic Growth of *Chlamydomonas reinhardtii* on Acetate in Chemostat Culture," Process Biochemistry, 31(6):601-604, (1996).
Ciferri, "Thiamine-deficiency of *Prototheca*, a Yeast-like Achloric Alga," Nature, 178:1475-1476, (1956).
Davies et al.,"Expression of the Arylsulfatase Gene from the Beta 2-Tubulin Promoter in *Chlamydomonas reinhardtii*," Nucleic Acids Research, 20(12):2959-2965, (1992).
De Cock, "Structure development in confectionery products: importance of triacylglycerol composistion," Master Thesis, Masters in Bioscience Engineering, Ghent University, 73 pages (2011).

Debuchy et al., "The arginiriosuccinate lyase gene of *Chlamydomonas reinhardtii*: an important tool for nuclear transformation and for correlating the genetic and molecular maps of the ARG7 locus," EMBO J., 8(10):2803-2809, (1989).
Deshnium et al., "Transformation of *Synechococcus* with a gene for choline oxidase enhances tolerance to salt stress," Plant Mol Biol, 29(5):897-907, (1995).
Erhan, "Vegetable Oils as Lubricants, Hydraulic Fluids, and Inks," Bailey's Industrial Oil and Fat Products, 6:259-278, (2005).
Franzen et al., "Chloroplast transit peptides from the green alga *Chlamydomonas reinhardtii* share features with both mitochondrial and higher plant chloroplast presequences," FEBS Letters, 206(2): 165-168, (1990).
Frenz et al., "Hydrocarbon recovery by extraction with a biocompatible solvent from free and immobilized cultures of *Botryococcus braunii*,"Enzyme Microb Technol, 11(11):717-724, (1989).
Frohns et al., "Potassium ion channels of *Chlorella* viruses cause rapid depolarization of host cells during infection," J Virol, 80(5):2437-2444, (2006).
Funes et al., "The typically mitochondrial DNA-encoded ATP6 subunit of the F1F0-ATPase is encoded by a nuclear gene in *Chlamydomonas reinhardtii*," J Biol Chem, 277(8):6051-6058, (2002).
Graves et al., "Hyaluronan synthesis in virus PBCV-1-infected *Chlorella*-like green algae," Virology, 257(1):15-23, (1999).
Gunstone, "Enzymes as biocatalysts in the modification of natural lipids," Journal of the Science of Food and Agriculture, 79:1535-1549, (1999).
Guschina et al., "Lipids and lipid metabolism in eukaryotic algae," Progress in Lipid Research, 45:160-186, (2006).
Hall et al., "Expression of a foreign gene in *Chlamydomonas reinhardtii*," Gene, 124(1):75-81, (1993).
Hillen et al., "Hydrocracking of the Oils of *Botryococcus braunii* to Transport Fuels," Biotechnology and Bioengineering, 24(1):193-205, (1982).
Hiramatsu et al., "Expression of chitinase gene and lysis of the host cell wall during *Chlorella* virus CVK2 infection," Virology, 260(2):308-315, (1999).
Hitz et al., "Cloning of a Higher-Plant Plastid Omega-6 Fatty Acid Desaturase cDNA and its Expression in a *Cyanobacterium*," Plant Physiology, 105(2):635-641, (1994).
Hu et al., "Microalgal Triacylglycerols as Feedstocks for Biofuel Production: Perspectives and Advances," The Plant Journal 54:621-639, (2008).
Huang et al., "Expression of Mercuric Reductase from *Bacillus magaterium* MB1 in Eukaryotic Mircoalga *Chlorella* sp. DT: An Approach for Mercury Phytoremediation," Appl. Microbiol. Biotechnol., 72:197-205, (2006).
Inoue et al., "Analysis of oil derived from liquefaction of *Botryococcus braunii*," Biomass and Bioenergy, 6(4):269-274, (1994).
Jakobiak et al., "The Bacterial Paromomycin Resistance Gene, aphH, as a Dominant Selectable Marker in *Volvox carteri*,"Protist, 55:381-393, (2004).
Jiang et al., "The actin gene promoter-driven bar as a dominant selectable marker for nuclear transformation of *Dunaliella salina*,"Yi Chuan Xue Bao, 32(4):424-433, (2005).
Kamiya, "Effects of Blue Light and Ammonia on Nitrogen Metabolism in a Colorless Mutant of *Chlorella*," Plant Cell Physiol., 30(4):513-521, (1989).
Kang et al., "Genetic diversity in *Chlorella* viruses flanking kcv, a gene that encodes a potassium ion channel protein," Virology, 326(1):150-159, (2004).
Kang et al., "The regulation activity of *Chlorella* virus gene 5' upstream sequence in *Escherichia coli* and eucaryotic alage," Institute of Microbiology, Chinese Academy of Sciences, Beijing, 16(4):443-6, (2000). Abstract only.
Kawasaki et al., "Characterization of Immediate Early Genes Expressed in Chlorovirus Infections," Nucleic Acids Symp Ser, 44:161-162, (2000).
Kawasaki et al., "Immediate Early Genes Expressed in Chlorovirus Infections," Virology, 318(1):214-223, (2004).

(56) References Cited

OTHER PUBLICATIONS

Kindle, "High-Frequency Nuclear Transformation of *Chlamydomonas reinhardtii*," Proc Natl Acad Sci, 87(3):1228-1232, (1990).
La Scala et al., "The effect of fatty acid composition on the acrylation kinetics of epoxidized triacylglycerols," Journal of the American Oil Chemists' Society, 79(1):59-63, (2002).
Lapidot et al., "Stable Chloroplast Transformation of the Unicellular Red Alga Porphyridium Species," Plant Physiol, 129:7-12, (2002).
Lindley, "The impact of food processing antioxidants in vegetable oils, fruits, and vegetables," Trends in Food Science & Technology. 9:336-340, (1998).
List et al., "Melting properties of some structured lipids native to high stearic acid soybean oil," Grasas y Aceites, 55(Fasc. 2):135-137, (2004).
Manuell et al., "Robust expression of a bioactive mammalian protein in *Chlamydomonas chloroplast*," Plant Biotech J, 5(3):402-412, (2007).
Mayfield et al., "Expression and Assembly of a Fully Active Anitbody in Algae," Proc Natl Acad Sci, 100(2):438-442, (2003).
Mendes et al., "Supercritical Carbon Dioxide Extraction of Compounds with Pharmaceutical Importance from Microalgae," Inorganica Chimica Acta, 356:328-334, (2003).
Metzger et al., "*Botryococcus braunii*: A Rich Source for Hydrocarbons and Related Ether Lipids," Applied Microbiology and Biotechnology, 66(5):486-496, (2005).
Minowa et al., "Oil Production from Algal Cells of *Dunaliella tertiolecta* by Direct thermochemical Liquefaction," Fuel, 74(12):1735-1738, (1995).
Mitra et al., "A *Chlorella* Virus Gene Promoter Functions as a Strong Promoter both in Plants and Bacteria," Biochemical and Biophysical Research Communications, 204(1):189-194, (1994).
Mitra et al., "The *Chlorella* Virus Adenine Methyltransferase Gene Promoter is a Strong Promoter in Plants," Plant Molecular Biology, 26(1):85-93, (1994).
Nahm, "Quality Characteristics of West African Shea Butter (*Vitellaria paradoxa*) and Approaches to Extend Shelf-Life," Master Thesis, Master of Science in Food Service, Rutgers, The State University of New Jersey, 133 pages, (2011).
Nazaruddin et al., "The Effect of Enzymatic Alcoholysis on the Physicochemical Properties of Commerical Cocoa Butter Subsitutes," Pakistan Journal of Nutrition, 10(8):718-723, (2011).
PCT International Preliminary Report on Patentability for application PCT/US2011/058224 mailed May 16, 2013.
PCT International Search Report and Written Opinion of the International Searching Authority for application PCT/US2013/037261 mailed Aug. 23, 2013.
PCT International Search Report for application PCT/US2011/059224 mailed Jun. 27, 2012.
Proschold et al., "Portrait of a Species: *Chlamydomonas reinhardtii*," Genetics, 170(4):1601-1610, (2005).
Qingyu et al., "Fine Cell Structure and Biochemical Compositions of *Chlorella* Protothecoides after Transferring from Autotrophic to Heterotrophic Metabolism," Journal of Nanjing University, Natural Sciences Edition, 29(4):622-630, (1993). Abstract.
Randolph-Anderson et al., "Further characterization of the respiratory deficient dum-1 mutation of *Chlamydomonas reinhardtii* and its use as a recipient for mitochondrial transformation," Mol Gen Genet, 236(2-3):235-244, (1993).
Running et al., "Extracellular production of L-ascorbic acid by *Chlorella* protothecoides, Prototheca species, and mutants of *P. moriformis* during aerobic culturing at a low pH," Journal of Industrial Mircobiology & Biotechnology, 29:93-98, (2002).
Sakuradani, "Studies of Metabolic Engineering of Useful Lipid-Producing Mircoorganisms," NISR Research Grant, (2004).
Sawayama et al., "Possibility of renewable energy production and CO2 mitigation by thermochemical liquefaction of microalgae." Biomass and Bioenergy, 17(1):33-39, (1999).
Schreier et al., "The use of nuclear-encoded sequences to direct the light-regulated synthesis and transport of a foreign protein into plant chloroplasts," EMBO J. 4(1):25-32, (1985).
Shao et al., "Cloning and expression of metallothionein mutant α-KKS-α in *Anabaena* sp. PCC 7120," Marine Pollution Bulletin, 45(1012):163-167, (2002).
Smith et al., "Production of hydroxy fatty acids in the seeds of *Arabidopsis thaliana*," Biochemical Society Transactions, 28(6):947-950, (2000).
Sorger et al., "Triacylglycerol biosynthesis in yeast," AppL. Microbiol Biotechnol, 61:289-299, (2003).
Suda et al., "Evidence for a novel *Chlorella* virus-encoded alginate lyase," FEMS Microbiology Letters, 180(1):45-53, (1999).
Sun et al., "Characterization of two chitinase genes and one chitosanase gene encoded by *Chlorella* virus PBCV-1," Virology, 263(2):376-387, (1999).
Swern et al., "Fractionation of tallow fatty acids: Preparation of purified oleic acid and on inedible olive oil substitute," Oil & Soap, 22(11):302-304 (1945).
Talbot et al., "Formulation and Production of Confectionary Fats," OFI Middle East 2007 Conference and Exhibition, 378 pages, (2007).
Tang et al., "Insertion mutagenesis of *Chlamydomonas reinhardtii* by electroporation and heterologous DNA," Biochem Mol Biol Int, 36(5):1023-1035, (1995).
U.S. Appl. No. 12/131,773, Non-Final Office Action mailed Jun. 5, 2013.
U.S. Appl. No. 12/131,738, Non-Final Office Action mailed Jul. 18, 2013.
U.S. Appl. No. 12/131,793, Notice of Allowance mailed Apr. 3, 2013.
U.S. Appl. No. 12/628,140, Final Office Action mailed Sep. 12, 2013.
U.S. Appl. No. 12/772,163, Notice of Allowance mailed May 28, 2013.
U.S. Appl. No. 12/772,173, Notice of Allowance mailed Mar. 29, 2013.
U.S. Appl. No. 12/960,388, Notice of Allowance mailed May 28, 2013.
U.S. Appl. No. 13/087,311, Non-Final Office Action mailed Apr. 23, 2013.
U.S. Appl. No. 13/118,365, Final Office Action mailed Jul. 22, 2013.
U.S. Appl. No. 13/464,948, Requirement for Restriction/Election mailed Aug. 21, 2013.
U.S. Appl. No. 13/479,200, Non-Final Office Action mailed Apr. 10, 2013.
U.S. Appl. No. 13/479,200, Non-Final Office Action mailed Sep. 9, 2013.
U.S. Appl. No. 13/527,480, Non-Final Office Action mailed Jun. 26, 2013.
U.S. Appl. No. 13/527,480, Requirement for Restriction/Election mailed May 3, 2013.
U.S. Appl. No. 13/543,666, Non-Final Action mailed Sep. 5, 2013.
U.S. Appl. No. 13/547,457, Non-Final Office Action mailed Jul. 8, 2013.
U.S. Appl. No. 13/558,252, Final Office Action mailed Jul. 9, 2013.
U.S. Appl. No. 13/621,722, Non-Final Office Action mailed May 9, 2013.
U.S. Appl. No. 13/628,039, Non-Final Office Action mailed Jun. 4, 2013.
U.S. Appl. No. 13/650,018, Requirement for Restriction/Election mailed Aug. 22, 2013.
U.S. Appl. No. 13/889,214, Non-Final Office Action mailed Sep. 18, 2013.
U.S. Appl. No. 13/889,221, Non-Final Office Action Sep. 6, 2013.
U.S. Appl. No. 12/772,173, Notice of Allowance mailed Jul. 10, 2013.
Urano, et al., "Effect of Osmotic Stabilizers on Protoplast Generation of *Chlorella ellipsoidea* Yellow/White Color Mutants," Journal of Bioscience and Bioengineering, 90(5):567-569, (2000).
Van Etten et al., "Giant viruses infecting algae," Annu Rev Microbiol, 53:447-494, (1999).

(56) References Cited

OTHER PUBLICATIONS

Vazquez-Bermudez et al., "Carbon Supply and 2-Oxgoglutarate Effects on Expression of Nitrate Reductase and Nitrogen-Regulated Genes in *Synechococcus* sp. strain PCC 7942," FEMS Microbiology Letters, 221(2):155-159, (2003).

Vazquez-Bermudez et al., "Uptake of 2-Oxoglutarate in *Synechococcus* Strains Transformed with the *Escherichia coli* kgtP Gene," Journal of Bacteriology, 182(1):211-215, (2000).

Walker et al., "Characterization of the *Dunaliella teriolecta* RbcS Genes and Their Promoter Activity in *Chlamydomonas reinhardtii*," Plant Cell Rep, 23(10-11):727-735, (2005).

Westphal, et al., "Vipp1 Deletion Mutant of Synechocystis: A Connection Between Bacterial Phage Shock and Thylakoid Biogenesis," Proc Natl Acad Sci U S A., 98(7):4243-4248, (2001).

Xiong et al., "High-density fermentation of microalga *Chlorella* protothecoides in bioreactor for microbio-diesel production," Appl. Microbiol. Biotechnol., 78:29-36, (2008).

Yamada et al., "Alternative expression of a chitosanase gene produces two different proteins in cells infected with *Chlorell* virus CVK2." Virology, 230(2):361-368, (1997).

Yamada et al., "*Chlorella* viruses," Adv Virus Res, 66:293-336, (2006).

Zhang et al., "Malic enzyme: the controlling activity for lipid production? Overexpression of malic enzyme in *Mucor circinelloides* leads to a 2.5-fold increase in lipid accumulation," Microbiology, 153(7):2013-2025, (2007).

Zurawski et al., "Nucleotide sequence of the gene for the Mr 32,000 thylakoid membrane protein from *Spinacia oleracea* and *Nicotiana debneyi* predicts a totally conserved primary translation product of Mr 38,950," Proc Natl Acad Sci, 79(24):7699-7703, (1982).

\* cited by examiner

US 8,633,012 B2

TAILORED OILS PRODUCED FROM RECOMBINANT OLEAGINOUS MICROORGANISMS

CROSS-REFERENCE TO RELATED APPLICATIONS

This application is a continuation of U.S. application Ser. No. 13/365,253, filed Feb. 2, 2012, which claims the benefit under 35 U.S.C. 119(e) of U.S. Provisional Patent Application No. 61/438,969, filed Feb. 2, 2011, U.S. Provisional Patent Application No. 61/476,691, filed Apr. 18, 2011, U.S. Provisional Patent Application No. 61/484,458, filed May 10, 2011, and U.S. Provisional Patent Application No. 61/548,616, filed Oct. 18, 2011. Each of these applications is incorporated herein by reference in its entirety for all purposes.

REFERENCE TO A SEQUENCE LISTING

This application includes an electronic sequence listing in a file named "425722-Sequence.txt", created on Oct. 11, 2012 and containing 757,511 bytes, which is hereby incorporated by reference in its entirety for all purposes.

FIELD OF THE INVENTION

The present invention relates to the production of oils, fuels, and oleochemicals made from microorganisms. In particular, the disclosure relates to oil-bearing microalgae, methods of cultivating them for the production of useful compounds, including lipids, fatty acid esters, fatty acids, aldehydes, alcohols, and alkanes, and methods and reagents for genetically altering them to improve production efficiency and alter the type and composition of the oils produced by them.

BACKGROUND OF THE INVENTION

Fossil fuel is a general term for buried combustible geologic deposits of organic materials, formed from decayed plants and animals that have been converted to crude oil, coal, natural gas, or heavy oils by exposure to heat and pressure in the earth's crust over hundreds of millions of years. Fossil fuels are a finite, non-renewable resource. Increased demand for energy by the global economy has also placed increasing pressure on the cost of hydrocarbons. Aside from energy, many industries, including plastics and chemical manufacturers, rely heavily on the availability of hydrocarbons as a feedstock for their manufacturing processes. Cost-effective alternatives to current sources of supply could help mitigate the upward pressure on energy and these raw material costs.

PCT Pub. No. 2008/151149 describes methods and materials for cultivating microalgae for the production of oil and particularly exemplifies the production of diesel fuel from oil produced by the microalgae *Chlorella protothecoides*. There remains a need for improved methods for producing oil for fuel, chemicals, foods and other uses, particularly for methods that produce oils with shorter chain length and a higher degree of saturation and without pigments, with greater yield and efficiency. The present invention meets this need.

A polyurethane is a compound that comprises a carbamate (urethane) linkage. Typically, a polyurethane is a polymer of organic units. The polymer is prepared by the reaction of a first organic unit comprising an isocyanate moiety (C(O)N—$R_1$—NC(O)) and a second organic unit comprising a hydroxyl group (HO—$R_2$—OH). A polyurethane can be represented as —[C(O)NH—$R_1$—NHC(O)—O—$R_2$—O]$_m$—, wherein the subscript m is a number that denotes the number of monomers contained in the polymer. $R_1$ and $R_2$ can be the same or different, but are typically different. Polyurethanes are used in many different applications including both flexible and rigid materials. Polyurethanes are used in shoes, automobiles, airplanes, bushings, gaskets, adhesives, carpeting, spandex fibers, housing for electronics and the like.

SUMMARY OF THE INVENTION

Illustrative embodiments of the present invention provide oleaginous cells that produce altered glycerolipid profiles and products produced from the cells. Examples of oleaginous cells include microbial cells having a type II lipid biosynthesis pathway. Embodiments also feature natural oils, which are obtainable using the cells. Embodiments include recombinant cells expressing exogenous genes encoding proteins such as fatty acyl-ACP thioesterases. The present invention also provides methods of making lipids and oil-based products, including fuels such as biodiesel, renewable diesel and jet fuel, food oils and chemicals from such cells.

In a first aspect, the present invention provides a microalgal cell having a lipid profile that is at least 3% C8:0. In some cases, the lipid profile is at least 12% C8:0. In some embodiments, the cell is a recombinant cell. In some cases, the recombinant cell comprises an exogenous gene encoding an acyl-ACP thioesterase protein that has hydrolysis activity towards fatty acyl-ACP substrates of chain length C8. In some embodiments, the exogenous gene encodes a *Cuphea palustris* acyl-ACP thioesterase. In some cases, the cell is a *Prototheca* cell. In some cases, the cell is of a microalgal genus or species selected from microalgae identified in Table 1.

In a second aspect, the present invention provides a microalgal cell having a lipid profile that is at least 4% C10:0. In some cases, the lipid profile is at least 18% C10:0. In some cases, the lipid profile is at least 20% C10:0. In some cases, the lipid content of the microalgal cell further comprises C12:0. In some cases, the ratio of C10:0 to C12:0 is at least 3:1. In some cases, the lipid content of the microalgal cell further comprises C14:0. In some cases, the ratio of C10:0 to C14:0 is at least 10:1. In some embodiments, the cell is a recombinant cell. In some cases, the recombinant cell comprises an exogenous gene encoding a fatty acyl-ACP thioesterase protein that has hydrolysis activity towards fatty acyl-ACP substrates of chain length C10. In some embodiments, the exogenous gene encodes a fatty acyl-ACP thioesterase protein from a species selected from the group consisting of *Cuphea hookeriana* and *Ulmus americana*. In some embodiments, the fatty acyl-ACP thioesterase protein is from a species selected from the group consisting of *Cuphea hookeriana* and *Ulmus americana*. In some case, the fatty acyl-ACP thioesterase gene is selected from the group consisting of a fatty acyl-ACP thioesterase gene from *Cuphea hookeriana* and *Ulmus americana* that has hydrolysis activity towards fatty acyl-ACP substrates of chain length C10.

In some cases, the cell is a *Prototheca* cell. In some embodiments, the cell is of a microalgal genus or species selected from microalgae identified in Table 1.

In a third aspect, the present invention provides a microalgal cell having a lipid profile that is at least 13% C12:0. In some cases, the cell is a recombinant cell. In some embodiments, the recombinant cell comprises an exogenous gene encoding a fatty acyl-ACP thioesterase protein that has hydrolysis activity towards fatty acyl-ACP substrates of chain length C12. In some embodiments, the fatty acyl-ACP thioesterase protein is from a species selected from the group consisting of *Umbellularia californica* and *Cinnamomum*

*camphora*. In some cases, the fatty acyl-ACP thioesterase gene is selected from the group consisting of a fatty acyl-ACP thioesterase gene from *Umbellularia californica* and *Cinnamomum camphora* that has hydrolysis activity towards fatty acyl-ACP substrates of chain length C12. In some embodiments, the cell is a *Prototheca* cell.

In a fourth aspect, the present invention provides a microalgal cell having a lipid profile that is at least 10% C14:0. In some cases, the lipid profile is at least 35% C14:0. In some cases, the lipid content of the microalgal cell further comprises C12:0. In some cases, the ratio of C14:0 to C12:0 is at least 3:1. In some cases, the cell is a recombinant cell. In some embodiments, the recombinant cell comprises an exogenous gene encoding a fatty acyl-ACP thioesterase protein that has hydrolysis activity towards fatty acyl-ACP substrates of chain length C14. In some embodiments, the fatty acyl-ACP thioesterase protein is from a species selected from the group consisting of *Cinnamomum camphora* and *Ulmus americana*. In some cases, the fatty acyl-ACP thioesterase gene is selected from the group consisting of a fatty acyl-ACP thioesterase gene from *Cinnamomum camphora* and *Ulmus americana* that has hydrolysis activity toward fatty acyl-ACP substrates of chain length C14. In some cases, the cell is a *Prototheca* cell. In some embodiments, the cell is of a microalgal genus or species selected from microalgae identified in Table 1.

In a fifth aspect, the present invention provides a microalgal cell having a lipid profile that is at least 15% C16:0. In some cases, the lipid profile is at least 39% C16:0. In some cases, the lipid profile is at least 67% C16:0. In some cases, the cell is a recombinant cell. In some embodiments, the recombinant cell comprises an exogenous gene encoding a fatty acyl-ACP thioesterase protein that has hydrolysis activity towards fatty acyl-ACP substrates of chain length C16. In some embodiments, the fatty acyl-ACP thioesterase protein is from a species selected from *Cuphea hookeriana* and *Ulmus americana*. In some embodiments, the recombinant cell comprises an exogenous gene encoding a fatty acyl-ACP thioesterase protein from a species selected from the group consisting of *Cuphea hookeriana* and *Ulmus americana* that have hydrolysis activity towards fatty acyl-ACP substrates of chain length C16. In some cases, the cell is a *Prototheca* cell. In some embodiments, the microalgal cell further comprises an endogenous desaturase gene, wherein the endogenous desaturase gene has been mutated to encode a desaturase that is inactive or less active than the non-mutated desaturase, or wherein, said endogenous desaturase has been deleted from the microalgal cell genome.

In a sixth aspect, the present invention provides a microalgal cell having a lipid profile that is at least 60% saturated fatty acids. In some cases the microalgal cell has a lipid profile that is at least 85% saturated fatty acids. In some cases, the cell is a recombinant cell. In some embodiments, the recombinant cell comprises an exogenous gene encoding a fatty acyl-ACP thioesterase protein that has hydrolysis activity towards fatty acyl-ACP substrates of chain lengths C10-C16. In some cases, the cell is a *Prototheca* cell.

In a seventh aspect, the present invention provides a microalgal cell having a lipid profile that is at least 19% C18:0. In some cases, the lipid profile is at least 27% C18:0. In some cases, the cell is a recombinant cell. In some embodiments, the recombinant cell comprises an exogenous gene encoding a fatty acyl-ACP thioesterase protein that has hydrolysis activity towards fatty acyl-ACP substrates of chain length C18. In some embodiments, the fatty acyl-ACP thioesterase protein is from a species selected from *Brassica napus*. In some embodiments, the recombinant cell comprises an exogenous gene encoding a fatty acyl-ACP thioesterase protein from *Brassica napus* that has hydrolysis activity towards fatty acyl-ACP substrates of chain length C16.

In an eighth aspect, the present invention provides a microalgal cell comprising an exogenous gene encoding a fatty acyl-ACP thioesterase protein from the group consisting of *Cuphea hookeriana, Umbellularia californica, Cinnamomun camphora, Cuphea palustris, Cuphea lanceolata, Iris germanica, Myristica fragrans, Garcinia mangostana, Elaeis guiniensis, Brassica napus, Ricinus communis* and *Ulmus americana*.

In an ninth aspect, the present invention provides a microalgal cell comprising an expression construct wherein the expression construct down-regulates the expression of an endogenous gene selected from the methods consisting of the endogenous gene has been mutated to encode a gene product that is inactive or less active than the non-mutated gene product, the endogenous gene has been deleted from the microalgal cell genome, and through a RNA-induced mechanism. In some cases, the method is a RNA-induced mechanism, such as RNAi, antisense and/or dsRNA. In some cases, the endogenous gene is a desaturase gene. In some embodiments, the desaturase gene is a delta 12 fatty acid desaturase gene. In some cases, the cell is a *Prototheca* cell.

In an tenth aspect, the present invention provides a microalgal cell as described in any of the above aspects, wherein the microalgal cell is cultivated using stachyose, raffinose or melibiose as a carbon source.

In an eleventh aspect, the present invention provides a microalgal cell having a lipid profile that is no more than 2% 18:2. In some cases, the present invention provides a microalgal cell having a lipid profile that is no more than 7% 18:2.

In a twelfth aspect, the present invention provides a method of making lipid. In one embodiment, the method comprises (a) cultivating a microalgal cell as discussed above until the cell is at least 20% lipid by dry weight; and (b) separating the lipid from water-soluble biomass components.

In a thirteenth aspect, the present invention provides another method of making lipid. In one embodiment, the method comprises (a) cultivating a microalgal cell containing two different exogenous genes encoding two different acyl-ACP thioesterases, and (b) separating the lipid from water-soluble biomass components. In some cases, at least one of the exogenous genes encodes a fatty acyl-ACP thioesterase selected from the group consisting of the thioesterases identified in Table 4.

In a fourteenth aspect, the present invention provides a method of making an oil-based product. In one embodiment, the method comprises (a) cultivating a microalgal cell as discussed above until the cell is at least 10% lipid by dry weight; (b) separating the lipid from the microalgal cell; (c) subjecting the lipid to at least one chemical reaction selected from the group consisting of: saponification; metathesis; acid hydrolysis; alkaline hydrolysis; enzymatic hydrolysis; catalytic hydrolysis; hot-compressed water hydrolysis; a catalytic hydrolysis reaction wherein the lipid is split into glycerol and fatty acids; an amination reaction to produce fatty nitrogen compounds; an ozonolysis reaction to produce mono- and dibasic-acids; a triglyceride splitting reaction selected from the group consisting of enzymatic splitting and pressure splitting; a condensation reaction that follows a hydrolysis reaction; a hydroprocessing reaction; a hydroprocessing reaction and a deoxygenation reaction and/or a condensation reaction prior to or simultaneous with the hydroprocessing reaction; a gas removal reaction; a deoxygenation reaction selected from the group consisting of a hydrogenolysis reaction, hydrogenation, a consecutive hydrogenation-hydrogenolysis reaction, a consecutive hydrogenolysis-hydrogenation reaction, and a combined hydrogenation-hydrogenolysis reaction; a condensation reaction following a deoxygenation reaction; an esterification reaction; an interesterification reaction; a transesterification reaction; a hydroxylation reaction; and a condensation reaction following a hydroxylation reaction; and (d) optionally isolating a product of the reaction from the other components, whereby an oil-based product is produced.

In some cases, the oil-based product is selected from soap or a fuel product. In some embodiments, the oil-based product is a fuel product selected from the group consisting biodiesel, renewable diesel, and jet fuel. In some cases, the fuel product is biodiesel with one or more of the following attributes: (i) 0.025-0.3 mcg/g, preferably 0.05-0.244 mcg/g, total carotenoids; (ii) less than 0.005 mcg/g, preferably less than 0.003 mcg/g, lycopene; (iii) less than 0.005 mcg/g, preferably less than 0.003 mcg/g, beta carotene; (iv) 0.025-0.3 mcg/g, preferably 0.045-0.268 mcg/g, chlorophyll A; (v) 35-175 mcg/g, preferably 38.3-164 mcg/g, gamma tocopherol; (vi) less than 0.25% brassicasterol, campesterol, stignasterol, or beta-sitosterol; (vii) 225-350 mcg/g, preferably 249.6-325.3 mcg/g, total tocotrienols; (viii) 0.0025-0.05 mcg/g, preferably 0.003-0.039 mcg/g, lutein; or (ix) 50-300 mcg/g, preferably 60.8-261.7 mcg/g, tocopherols. In some cases, the fuel product is renewable diesel that has a T10-T90 of at least 20° C., 40° C. or 60° C. In some cases, the fuel product is jet fuel that meets HRJ-5 and/or ASTM specification D1655.

In a fifteenth aspect, the present invention provides a triglyceride oil comprising (a) a lipid profile of at least 1-5%, preferably at least 3%, C8:0, at least 2.5%, preferably at least 4%, C10:0, at least 10%, preferably at least 13%, C12:0, at least 10% C14:0, and/or at least 60% saturated fatty acids, and (b) one or more of the following attributes: (i) 0.025-0.3 mcg/g, preferably 0.05-0.244 mcg/g, total carotenoids; (ii) less than 0.005 mcg/g, preferably less than 0.003 mcg/g, lycopene; (iii) less than 0.005 mcg/g, preferably less than 0.003 mcg/g, beta carotene; (iv) 0.025-0.3 mcg/g, preferably 0.045-0.268 mcg/g, chlorophyll A; (v) 35-175 mcg/g, preferably 38.3-164 mcg/g, gamma tocopherol; (vi) less than 0.25% brassicasterol, campesterol, stignasterol, or beta-sitosterol; (vii) 225-350 mcg/g, preferably 249.6-325.3 mcg/g, total tocotrienols; (viii) 0.0025-0.05 mcg/g, preferably 0.003-0.039 mcg/g, lutein; or (ix) 50-300 mcg/g, preferably 60.8-261.7 mcg/g, tocopherols.

In a sixteenth aspect, the present invention provides a triglyceride oil isolated from microalgae that has a C8:C10 fatty acid ratio of at least 5:1. In some embodiments, the triglyceride oil is isolated from microalgal cell (e.g., of the genus *Prototheca*), wherein the microalgal cell comprises an exogenous gene. In a related aspect, the present invention provides a triglyceride oil isolated from microalgae with at least 60% saturated fatty acids.

In another related aspect, the present invention provides a triglyceride oil isolated from microalgae having a lipid profile that has a C16:14 fatty acid ratio of about 2:1. In another related aspect, the present invention provides a triglyceride oil produced by a microalgal cell, wherein the microalgal cell comprises an exogenous gene. In some cases, the microalgae is of the genus *Prototheca*.

In another related aspect, the present invention provides a triglyceride oil isolated from microalgae having a lipid profile that has a C12:14 fatty acid ratio of about 3:1. In another related aspect, the present invention provides a triglyceride oil produced by a microalgal cell, wherein the microalgal cell comprises an exogenous gene. In some cases, the microalgae is of the genus *Prototheca*.

In a seventeenth aspect, the present invention provides a triglyceride oil comprising (a) a lipid profile of less than 1%<C12; between 1%-10%, preferably 2%-7%, C14:0; between 20%-35%, preferably 23%-30%, C16:0; between 5%-20%, preferably 7%-15%, C18:0; between 35%-60%, preferably 40%-55%, C18:1; and between 1%-20%, preferably 2%-15%, C18:2 fatty acids; and (b) one or more of the following attributes: (i) 0.025-0.3 mcg/g, preferably 0.05-0.244 mcg/g, total carotenoids; (ii) less than 0.005 mcg/g, preferably less than 0.003 mcg/g, lycopene; (iii) less than 0.005 mcg/g, preferably less than 0.003 mcg/g, beta carotene; (iv) 0.025-0.3 mcg/g, preferably 0.045-0.268 mcg/g, chlorophyll A; (v) 35-175 mcg/g, preferably 38.3-164 mcg/g, gamma tocopherol; (vi) less than 0.25% brassicasterol, campesterol, stignasterol, or beta-sitosterol; (vii) 225-350 mcg/g, preferably 249.6-325.3 mcg/g, total tocotrienols; (viii) 0.0025-0.05 mcg/g, preferably 0.003-0.039 mcg/g, lutein; or (ix) 50-300 mcg/g, preferably 60.8-261.7 mcg/g, tocopherols.

In some cases, the triglyceride oil is isolated from a microbe comprising one or more exogenous gene. In some embodiments, the one or more exogenous gene encodes a fatty acyl-ACP thioesterase. In some cases, the fatty acyl-ACP thioesterase has hydrolysis activity towards fatty acyl-ACP substrates of chain length C14. In some embodiments, the microbe further comprising expression construct wherein the expression construct down-regulates the expression of an endogenous gene selected from the methods consisting of the endogenous gene has been mutated to encode a gene product that is inactive or less active than the non-mutated gene product, the endogenous gene has been deleted from the microalgal cell genome, and through a RNA-induced mechanism. In some embodiments, the endogenous gene encodes a desaturase. In some cases, the desaturase is a stearoyl-acyl carrier protein desaturase (SAD) or a fatty acid desaturase (FAD).

In an eighteenth aspect, the present invention provides a method of producing a triglyceride oil comprising a lipid profile of less than 1%<C12; between 2%-7% C14:0; between 23%-30% C16:0; between 7%-15% C18:0; between 40-55% C18:1; and between 2-15% C18:2 fatty acids, wherein the triglyceride oil is isolated from a microbe comprising one or more exogenous gene. In some cases, the triglyceride oil comprises a lipid profile of 3-5% C14:0; 25-27% C16:0; 10-15% C18:0; and 40-45% C18:1. In some embodiments, the one or more exogenous gene encodes a fatty acyl-ACP thioesterase. In some cases, the fatty acyl-ACP thioesterase has hydrolysis activity towards fatty acyl-ACP substrates of chain length C14.

In a nineteenth aspect, the present invention provides a microbial cell that produces ricinoleic acid. In some cases, the microbial cell is a microalgal cell. In some cases, the microbial cell and the microalgal cell comprises an exogenous gene that encodes a fatty acid hydroxylase. In some embodiments, the fatty acid hydroxylase is an oleate 12-hydroxylase. In some cases, the fatty acid hydroxylase is from *Ricinus communis*. In some cases, the microbial cell is of the genus *Prototheca*, such as, for example *Prototheca moriformis*.

In a twentieth aspect, the present invention provides a microalgal cell comprising an exogenous gene that encodes an alpha-galactosidase. In some cases, the microalgal cell comprising an exogenous gene that encodes an alpha-galactosidase wherein the alpha-galactosidase is secreted. In some embodiments, the exogenous gene that encodes an alpha-galactosidase is from a genus selected from the group consisting of *Saccharomyces*, *Aspergillus* and *Cyamopsis*.

In a twentyfirst aspect, the present invention provides a method of producing a lipid composition comprising the steps of: (a) cultivating a microalgal cell under heterotrophic conditions in the presence of a fixed carbon source, wherein the microalgal cell comprises an exogenous gene encoding an alpha-galactosidase and the fixed carbon source is selected from the group consisting of raffinose, stachyose and melibiose; (b) separating the lipid from the non-lipid components; thereby producing a lipid composition. In some cases, the microalgal cell is of the genus *Prototheca*.

In a twentysecond aspect, the present invention provides a microalgal cell comprising an exogenous gene that encodes a THIC enzyme. In some cases, the THIC enzyme is from a genus selected from the group consisting of *Coccomyxa*, *Arabidopsis*, and *Synechocystis*.

In another aspect, the present invention provides a method of cultivating a microalgal cell in the absence of thiamine comprising expressing an exogenous gene that encodes a THIC enzyme. In some cases, the THIC enzyme is from a genus selected from the group consisting of *Coccomyxa*, *Arabidopsis*, and *Synechocystis*.

In other aspects, the present invention provides a microalgal cell as described herein, wherein said microalgal cell further comprises another exogenous gene selected from the group consisting of a sucrose invertase, an alpha-galactosidase, and a THIC enzyme.

Another aspect of this invention provides a hydroxylated oil isolated from a microbial cell. In one aspect, the hydroxylated oil is isolated from a microbial cell, wherein the microbial cell is a microalgal cell (e.g., of the genus *Prototheca*). In a further aspect, the hydroxylated oil is isolated from a *Prototheca moriformis* cell. In one embodiment, the hydroxylated oil is a hydroxylated triglyceride. The hydroxylated triglyceride may be chemically similar or identical to castor oil.

A further aspect of the invention is a hydroxylated fatty acid. One embodiment of the hydroxylated fatty acid is ricinoleic acid.

In yet another aspect, the microbial hydroxylated oil or hydroxylated fatty acid is further hydroxylated. When ricinoleic acid is hydroxylated, a fatty acid containing two hydroxyl groups is provided.

Yet another aspect of the invention provides a composition prepared by reacting a hydroxylated oil and/or a hydroxylated fatty acid with a compound that contains an isocyanate moiety to form a polyurethane.

Another aspect of the invention provides a microalgal cell having a lipid profile that is at least 20% C18:2. In some cases, the microalgal cell has a lipid profile that is at least 30% C18:2. In some cases, the microalgal cell has a lipid profile that is at least 40% C18:2. In some cases, the microalgal cell has a lipid profile that is at least 50% C18:2.

Another aspect of the invention provides a method of making a lipid, comprising: (a) cultivating a microalgal cell in a culture medium and monitoring the sugar concentration; (b) when the sugar concentration of the culture medium reaches less than about 1 gram per liter, adding a first sugar solution to the culture medium at a continuous rate of between about 2 grams per hour per liter to about 10 grams per hour per liter for about 2 to about 24 hours; (c) adding a second sugar solution to the culture medium to maintain the sugar concentration of the culture medium at about 15 to about 20 grams per liter; and (d) isolating the lipid from the microalgal biomass. In some cases, the first sugar solution is added to the culture medium at a rate of about 4 grams of sucrose per hour per liter to about 6 grams of sucrose per hour per liter. In some cases, the first sugar solution is added to the culture medium at a rate of about 5.25 grams of sucrose per hour per liter. In some cases, the sugar is sucrose or glucose.

Another aspect of the invention provides a microalgal cell having a lipid profile that is at least 10% C18:3. In some cases, the microalgal cell has a lipid profile that is at least 20% C18:3. In some cases, the microalgal cell has a lipid profile that is at least 30% C18:3. In some cases, the microalgal cell has a lipid profile is at least 40% C18:3. In some cases, the microalgal cell has a lipid profile is at least 50% C18:3.

Another aspect of the invention provides a microorganism that produces a triglyceride comprising linoleic acid or linolenic acid, wherein the microorganism comprises a recombinant nucleic acid encoding a β-ketoacyl-ACP synthase II (KAS II) enzyme. In some cases, the microorganism further comprises a recombinant nucleic acid encoding a stearoyl ACP desaturase (SAD) enzyme. In some cases, the microorganism further comprises a recombinant nucleic acid encoding an oleate-specific thioesterase enzyme. In some cases, the microorganism further comprises a recombinant nucleic acid encoding a fatty acid desaturase (FAD) enzyme. In some cases, the microorganism further comprises a recombinant nucleic acid encoding a glycerolipid desaturase.

In the engineered microorganisms discussed above, the KAS II enzyme can comprise an amino acid sequence selected from the group consisting of SEQ ID NO: 175, SEQ ID NO: 176, SEQ ID NO: 177, SEQ ID NO: 178 and SEQ ID NO: 179. In some cases, the SAD enzyme can comprise an amino acid sequence selected from the group consisting of SEQ ID NO: 172, SEQ ID NO: 196, SEQ ID NO: 197, SEQ ID NO: 198, SEQ ID NO: 199, SEQ ID NO: 200, and SEQ ID NO: 201. In some cases, the oleate-specific thioesterase enzyme can comprise an amino acid sequence selected from the group consisting of SEQ ID NO: 195, SEQ ID NO: 202, SEQ ID NO: 203, SEQ ID NO: 204, SEQ ID NO: 205, and SEQ ID NO: 206. In some cases, the FAD enzyme can comprise an amino acid sequence selected from the group consisting of SEQ ID NO: 181, SEQ ID NO: 182. SEQ ID NO: 183, SEQ ID NO: 184 and SEQ ID NO: 185. In some cases, the FAD enzyme is a 412 FAD enzyme comprising an amino acid sequence selected from the group consisting of SEQ ID NO: 207, SEQ ID NO: 208, SEQ ID NO: 209, SEQ ID NO: 210, SEQ ID NO: 211, and SEQ ID NO: 212. In some cases, the FAD enzyme is a 415 FAD enzyme comprising an amino acid sequence selected from the group consisting of SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, and SEQ ID NO: 221. In some cases, the glycerolipid desaturase is a ω-6 fatty acid desaturase, a ω-3 fatty acid desaturase, or a ω-6 oleate desaturase.

Any one of the engineered microorgansims discussed above can further comprise a recombinant nucleic acid encoding a sucrose utilization pathway enzyme. In some cases, the sucrose utilization pathway enzyme is a sucrose invertase.

In any one of the engineered microorganisms discussed above, the microorganism can be further engineered to increase the proportion of linoleic acid or linolenic acid relative to other fatty acids.

In any one of the engineered microorganisms discussed above, the microorganism can be further engineered to overexpress a thioesterase specific for or preferential to C18 substrates.

In any one of the engineered microorganisms discussed above, the microorganism can be further engineered to decrease expression of a thioesterase specific for or preferential to a C8-C16 substrate.

In any one of the engineered microorganisms discussed above, the microorganism can be a microalgal cell. In some cases, the microalgal cell is of the genus *Prototheca*. In some cases, the microalgal cell is a *Prototheca moriformis* cell.

Another aspect of the invention provides an oil produced by any one of the engineered microorganisms discussed above.

Another aspect of the invention provides methods of producing the engineered microorganisms discussed above by introducing into the microorganisms one or more of the recombinant nucleic acids to produce triglycerides comprising linoleic acid or linolenic acid.

Another aspect of the invention provides a method for producing a natural oil comprising triacylglycerides, or a product produced from the natural oil, in which the method comprises (i) cultivating a cell of a recombinant microorganism, the cell comprising recombinant nucleic acids operable to (a) decrease or eliminate the expression of an enzyme encoded by one or more genes that encode a β-ketoacyl-ACP synthase I, β-ketoacyl-ACP synthase II, stearoyl ACP desaturase, fatty acid desaturase, or acyl-ACP thioesterase, and optionally wherein the cell comprises recombinant nucleic acids operable to decrease or eliminate the expression of two copies of a gene encoding a β-ketoacyl-ACP synthase I, β-ketoacyl-ACP synthase II, stearoyl ACP desaturase, or fatty acid desaturase, or acyl-ACP thioesterase; or (b) express a product of an exogenous gene encoding an active β-ketoacyl-ACP synthase I, β-ketoacyl-ACP synthase II, stearoyl ACP desaturase, or fatty acid desaturase, or acyl-ACP thioesterase; or (c) decrease or eliminate the expression of an enzyme encoded by one or more genes that encode a β-ketoacyl-ACP synthase I or β-ketoacyl-ACP synthase II, and express a product of an exogenous gene encoding an active stearoyl ACP desaturase, fatty acid desaturase, or acyl-ACP thioesterase; or (d) decrease or eliminate the expression of an enzyme encoded by one or more genes that encode a stearoyl ACP desaturase or fatty acid desaturase, and express a product of an exogenous gene encoding an active β-ketoacyl-ACP synthase I, β-ketoacyl-ACP synthase II, or acyl-ACP thioesterase; and (ii) recovering the natural oil from the cell, and optionally further processing the natural oil to produce a food, fuel, or chemical product, wherein the natural oil has an altered fatty acid profile due to the recombinant nucleic acids.

In some cases, the microorganism synthesizes fatty acids through a type II fatty acid biosynthesis pathway. In some cases, the microorganism is a microalga. In some cases, the microalga is an obligate heterotroph. In some cases, the microalga is a species of *Prototheca* or *Chlorella*. In some cases, the microalga is *Prototheca wickerhamii, Prototheca stagnora, Prototheca portoricensis, Prototheca moriformis*, or *Prototheca zopfii*. In some cases, the microalga is *Chlorella kessleri, Chlorella luteoviridis Chlorella protothecoides*, or *Chlorella vulgaris*. In some cases, the cell is a recombinant cell expressing an active sucrose invertase. In some cases, the cultivating is heterotrophic. In some cases, the fatty acid desaturase is one or more of a ω-6 fatty acid desaturase, a ω-3 fatty acid desaturase, or a ω-6 oleate desaturase, or a delta 12 fatty acid desaturase. In some cases, the cell is cultivated so as to comprise between at least 50%, at least 60%, at least 70%, or 50 and 90% triglyceride by dry cell weight. In some cases, the oil comprises less than 500, 50, or 5 ppm of colored molecules. In some cases, the recombinant nucleic acids are stably integrated. In some cases, the recombinant nucleic acids are stably integrated into the chromosome of the microorganism. In some cases, the cell further comprises at least one selectable marker.

In some cases, the cell comprises recombinant nucleic acids operable to decrease or eliminate the expression of an enzyme through expression of antisense, RNAi, or dsRNA targeting the transcript of a gene encoding for the enzyme. In some cases, the decrease or eliminatation of the expression of an enzyme encoded by one or more genes that encode a β-ketoacyl-ACP synthase I, β-ketoacyl-ACP synthase II, stearoyl ACP desaturase, or fatty acid desaturase is due to the interruption or replacement of the one or more genes with one or more genes encoding an active β-ketoacyl-ACP synthase I, β-ketoacyl-ACP synthase II, stearoyl ACP desaturase, or fatty acid desaturase, or acyl-ACP thioesterase. In some cases, the recombinant cell further comprises an exogenous gene encoding an oleate 12-hydroxylase, so as to synthesize ricinoleic acid. In some cases, the recombinant cell comprises nucleic acids operable to decrease or eliminate the expression of a β-ketoacyl-ACP synthase II encoded by a KASII gene, and to express a product of an exogenous gene encoding an acyl-ACP thioesterase. In some cases, the cell produces an oil with a fatty acid profile characterized by having at least 40, 50, 60, 70, or 80% C16 fatty acids. In some cases, the cell produces an oil with a fatty acid profile characterized by having at least 50-75% C16:0. In some cases, the cell produces an oil with a fatty acid profile further characterized by having at least 20-40% C18:1. In some cases, the exogenous gene encoding an acyl-ACP thioesterase produces an active acyl-ACP thioesterase having greater activity in hydrolysis of C8-C16 fatty acyl chains than a native acyl-ACP-thioestearase of the cell. In some cases, the exogenous gene encoding an acyl-ACP thioesterase interrupts the KASII gene. In some cases, the recombinant cell comprises nucleic acids operable to decrease or eliminate the expression of an enzyme encoded by one or more genes that encode a β-ketoacyl-ACP synthase I.

In some cases, the oil produced has a fatty acid profile characterized by a shorter mean fatty acid chain length as a result of the recombinant nucleic acids. In some cases, the recombinant cell comprises nucleic acids operable to decrease or eliminate the expression of a fatty acid desaturase encoded by at least one FAD gene and express a product of a stearoyl-ACP desaturase exogenous gene encoding an active stearoyl ACP desaturase. In some cases, nucleic acids are operable to decrease or eliminate the expression of a fatty acid desaturase encoded by multiple copies of a fatty acid desaturase gene. In some cases, the Stearoyl-ACP desaturase exogenous gene is recombined into a locus within the coding region of the fatty acid desaturase gene. In some cases, the oil produced has a fatty acid profile having elevated oleic acid. In some cases, the oleic acid comprises at least 50, 60, 70, 80, or 90% of the fatty acids. In some cases, the recombinant cell comprises nucleic acids operable to express a product of a β-ketoacyl-ACP synthase II exogenous gene encoding an active β-ketoacyl-ACP synthase II. In some cases, the oil produced is characterized by a fatty acid profile elevated in C18:1 fatty acids and reduced in C16 fatty acids as a result of the recombinant nucleic acids. In some cases, the recombinant cell comprises nucleic acids operable to decrease or eliminate the expression of an enzyme encoded by one or more genes that encode a stearoyl ACP desaturase by RNA interference. In some cases, the oil produced has a fatty acid profile characterized by an increase in C18:0 fatty acids. In some cases, the oil produced is characterized by a fatty acid profile having at least 50, 60, 70, 80, or 90% C18:0. In some cases, the oil produced is characterized by a fatty acid profile having at least 50-75% C18:0. In some cases, the oil produced is further characterized by a fatty acid profile having at least 20-40% C18:1. In some cases, the cell comprises recombinant nucleic acids operable to decrease or eliminate the expression of two copies of a gene encoding a β-ketoacyl-ACP synthase I, β-ketoacyl-ACP synthase II, stearoyl ACP desaturase, or fatty acid desaturase. In some cases, the nucleic acids are operable to express a product of a fatty acid desaturase exogenous gene encoding an active a ω-3 fatty acid desaturase and/or a ω-6 oleate desaturase. In some cases, the oil produced has a fatty acid profile characterized by an elevated level of linoleic acid, linolenic acid, or both. In some cases, the fatty acid profile of the oil is characterized by having at least 10, 20, 30, 40, or 50% linoleic acid, linolenic acid, or both. In some cases, the further processing of the oil comprises one or more of refining, bleaching, deodorizing, metathesis, transesterification, hydrogenation, hydrolysis, hydrogenation, deoxygenation, hydrocracking, isomerization, hydrolxylation, interesterification, amidation, sulfonation, and sulfurization. In some cases, the oil is processed to create a food oil, fatty acids, a fatty alcohol, a lubricant, a soap, a fatty acid ester, a fatty acid ethoxylate, a fatty amine, an alkyl chloride, a fatty alchohol ethoxylate, a fatty alcohol sulfate, a fatty acid alkanolamide, a sulfonated oil, a sulfurized oil, diesel fuel, jet fuel, gasoline, fuel blendstock, fuel additive, lubricant additive, or coating.

Another aspect of the invention provides natural oil obtainable by the methods discussed above.

Another aspect of the invention provides a product made from the natural oil discussed above. In some cases, the product comprises a food oil, fatty acids, a fatty alcohol, a lubricant, a soap, a fatty acid ester, a fatty acid ethoxylate, a fatty amine, an alkyl chloride, a fatty alchohol ethoxylate, a fatty alcohol sulfate, a fatty acid alkanolamide, a sulfonated oil, a sulfurized oil, diesel fuel, jet fuel, gasoline, fuel blendstock, fuel additive, chemical additive, or coating.

Another aspect of the invention provides a recombinant cell comprising recombinant nucleic acids operable to (a) decrease or eliminate the expression of an enzyme encoded by one or more genes that encode a β-ketoacyl-ACP synthase I, β-ketoacyl-ACP synthase II, stearoyl ACP desaturase, fatty acid desaturase, or acyl-ACP thioesterase, and optionally wherein the cell comprises recombinant nucleic acids operable to decrease or eliminate the expression of two copies of a gene encoding a β-ketoacyl-ACP synthase I, β-ketoacyl-ACP synthase II, stearoyl ACP desaturase, or fatty acid desaturase, or acyl-ACP thioesterase; or (b) express a product of an exogenous gene encoding an active β-ketoacyl-ACP synthase I, β-ketoacyl-ACP synthase II, stearoyl ACP desaturase, or fatty acid desaturase, or acyl-ACP thioesterase; or (c) decrease or eliminate the expression of an enzyme encoded by one or more genes that encode a β-ketoacyl-ACP synthase I or β-ketoacyl-ACP synthase II, and express a product of an exogenous gene encoding an active stearoyl ACP desaturase, fatty acid desaturase, or acyl-ACP thioesterase; or (d) decrease or eliminate the expression of an enzyme encoded by one or more genes that encode a stearoyl ACP desaturase or fatty acid desaturase, and express a product of an exogenous gene encoding an active β-ketoacyl-ACP synthase I, β-ketoacyl-ACP synthase II, or acyl-ACP thioesterase.

In some cases, the microorganism synthesizes fatty acids through a type II fatty acid biosynthesis pathway. In some cases, the microorganism is a microalga. In some cases, the microalga is an obligate heterotroph. In some cases, the microalga is a species of *Protheca* or *Chlorella*. In some cases, the microalga is *Prototheca wickerhamii, Prototheca stagnora, Prototheca portoricensis, Prototheca moriformis*, or *Prototheca zopfii*. In some cases, the microalga is *Chlorella kessleri, Chlorella luteoviridis Chlorella prototheocoides*, or *Chlorella vulgaris*. In some cases, the cell is a recombinant cell expressing an active sucrose invertase. In some cases, the cell is capable of heterotrophic growth. In some cases, the fatty acid desaturase is one or more of a ω-6 fatty acid desaturase, a ω-3 fatty acid desaturase, or a ω-6 oleate desaturase, or a delta 12 fatty acid desaturase. In some cases, the cell is capable of being cultivated so as to comprise between at least 50%, at least 60%, at least 70%, or 50 and 90% triglyceride by dry cell weight. In some cases, the recombinant nucleic acids are stably integrated. In some cases, the recombinant nucleic acids are stably integrated into the chromosome of the microorganism. In some cases, the cell further comprises at least one selectable marker. In some cases, the cell comprises recombinant nucleic acids operable to decrease or eliminate the expression of an enzyme through expression of antisense, RNAi, or dsRNA targeting the transcript of a gene encoding for the enzyme. In some cases, the decrease or eliminatation of the expression of an enzyme encoded by one or more genes that encode a β-ketoacyl-ACP synthase I, β-ketoacyl-ACP synthase II, stearoyl ACP desaturase, or fatty acid desaturase is due to the interruption or replacement of the one or more genes with one or more genes encoding an active β-ketoacyl-ACP synthase I, β-ketoacyl-ACP synthase II, stearoyl ACP desaturase, or fatty acid desaturase, or acyl-ACP thioesterase.

In some cases, the recombinant cell further comprises an exogenous gene encoding an oleate 12-hydroxylase, so as to synthesize ricinoleic acid. In some cases, the recombinant cell comprises nucleic acids operable to decrease or eliminate the expression of a β-ketoacyl-ACP synthase II encoded by a KASII gene, and to express a product of an exogenous gene encoding an acyl-ACP thioesterase. In some cases, the cell produces an oil with a fatty acid profile characterized by having at least 40, 50, 60, 70, or 80% C16 fatty acids. In some cases, the cell produces an oil with a fatty acid profile characterized by having at least 50-75% C16:0. In some cases, the cell produces an oil with a fatty acid profile further characterized by having at least 20-40% C18:1. In some cases, the exogenous gene encoding an acyl-ACP thioesterase produces an active acyl-ACP thioesterase having greater activity in hydrolysis of C8-C16 fatty acyl chains than a native acyl-ACP-thioestearase of the cell. In some cases, the exogenous gene encoding an acyl-ACP thioesterase interrupts the KASII gene. In some cases, the recombinant cell comprises nucleic acids operable to decrease or eliminate the expression of an enzyme encoded by one or more genes that encode a β-ketoacyl-ACP synthase I. In some cases, the oil produced has a fatty acid profile characterized by a shorter mean fatty acid chain length as a result of the recombinant nucleic acids. In some cases, the recombinant cell comprises nucleic acids operable to decrease or eliminate the expression of a fatty acid desaturase encoded by at least one FAD gene and express a product of a stearoyl-ACP desaturase exogenous gene encoding an active stearoyl ACP desaturase. In some cases, the nucleic acids are operable to decrease or eliminate the expression of a fatty acid desaturase encoded by multiple copies of a fatty acid desaturase gene. In some cases, the Stearoyl-ACP desaturase exogenous gene is recombined into a locus within the coding region of the fatty acid desaturase gene.

In some cases, the oil produced has a fatty acid profile having elevated oleic acid. In some cases, the oleic acid comprises at least 50, 60, 70, 80, or 90% of the fatty acids. In some cases, the recombinant cell comprises nucleic acids operable to express a product of a β-ketoacyl-ACP synthase II exogenous gene encoding an active β-ketoacyl-ACP synthase II. In some cases, the oil produced is characterized by a fatty acid profile elevated in C18:1 fatty acids and reduced in C16 fatty acids as a result of the recombinant nucleic acids. In some cases, the recombinant cell comprises nucleic acids operable to decrease or eliminate the expression of an enzyme encoded by one or more genes that encode a stearoyl ACP desaturase by RNA interference. In some cases, the oil produced has a fatty acid profile characterized by an increase in C18:0 fatty acids. In some cases, the oil produced is characterized by a fatty acid profile having at least 50, 60, 70, 80, or 90% C18:0. In some cases, the oil produced is characterized by a fatty acid profile having at least 50-75% C18:0. In some cases, the oil produced is further characterized by a fatty acid profile having at least 20-40% C18:1. In some cases, the cell comprises recombinant nucleic acids operable to decrease or eliminate the expression of two copies of a gene encoding a β-ketoacyl-ACP synthase I, β-ketoacyl-ACP synthase II, stearoyl ACP desaturase, or fatty acid desaturase. In some cases, the nucleic acids are operable to express a product of a fatty acid desaturase exogenous gene encoding an active a ω-3 fatty acid desaturase and/or a ω-6 oleate desaturase. In some cases, the oil produced has a fatty acid profile characterized by an elevated level of linoleic acid, linolenic acid, or both. In some cases, the fatty acid profile of the oil is characterized by having at least 10, 20, 30, 40, or 50% linoleic acid, linolenic acid, or both.

Another aspect of the invention provides a natural oil or oil-containing product produced from the cells described above.

Another aspect of the invention provides a method for producing a natural oil comprising triacylglycerides that comprise ricinoleic acid, or a product produced from the natural oil, the method comprising cultivating a cell of a recombinant microorganism, the cell comprising recombinant nucleic acids operable to express a product of an exogenous gene encoding an active oleate 12-hydroxylase, so as to synthesize the ricinoleic acid.

In some cases, the microorganism has a type II fatty acid biosynthesis pathway. In some cases, the microorganism is a microalga. In some cases, the microalga is an obligate heterotroph. In some cases, the microalga is a species of *Prototheca*. In some cases, the microalga is *Prototheca wickerhamii, Prototheca stagnora, Prototheca portoricensis, Prototheca moriformis*, or *Prototheca zopfii*. In some cases, the microalga is *Chlorella kessleri, Chlorella luteoviridis Chlorella prototheocoides*, or *Chlorella vulgaris*. In some cases, the cell is a recombinant cell expressing an active sucrose invertase. In some cases, the cultivating is heterotrophic. In some cases, the cell produces at least 40, 50, 60, 70, 80, or 90% oleic acid absent the recombinant nucleic acids operable to express a product of an exogenous gene encoding an active oleate 12-hydroxylase. In some cases, the cell further comprises recombinant nucleic acids operable to enhance oleic acid production so as to elevate the substrate levels for the oleate 12-hydroxylase. In some cases, the cell comprises recombinant nucleic acids operable to (a) express a product of an exogenous gene encoding an active stearoyl ACP desaturase and decrease or eliminate the expression of an enzyme encoded by one or more genes that encode a fatty acid desaturase; or (b) express a product of an exogenous gene encoding an active β-ketoacyl-ACP synthase I and express a product of an exogenous gene encoding an active acyl-ACP thioesterase.

Another aspect of the invention provides a product produced according to any of the methods discussed above.

Another aspect of the invention provides a microorganism cell comprising recombinant nucleic acids operable to express a product of an exogenous gene encoding an active oleate 12-hydroxylase, so as to synthesize ricinoleic acid.

In some cases, the microorganism has a type II fatty acid biosynthesis pathway. In some cases, the microorganism is a microalga. In some cases, the microalga is an obligate heterotroph. In some cases, the microalga is a species of *Prototheca*. In some cases, the microalga is *Prototheca wickerhamii, Prototheca stagnora, Prototheca portoricensis, Prototheca moriformis*, or *Prototheca zopfii*. In some cases, the microalga is *Chlorella kessleri, Chlorella luteoviridis Chlorella prototheocoides*, or *Chlorella vulgaris*. In some cases, the cell is a recombinant cell expressing an active sucrose invertase. In some cases, the cell is capable of heterotrophic growth. In some cases, the cell produces at least 40, 50, 60, 70, 80, or 90% oleic acid absent the recombinant nucleic acids operable to express a product of an exogenous gene encoding an active oleate 12-hydroxylase. In some cases, the cell further comprises recombinant nucleic acids operable to enhance oleic acid production so as to elevate the substrate levels for the oleate 12-hydroxylase. In some cases, the cell comprises recombinant nucleic acids operable to (a) express a product of an exogenous gene encoding an active stearoyl ACP desaturase and decrease or eliminate the expression of an enzyme encoded by one or more genes that encode a fatty acid desaturase; or (b) express a product of an exogenous gene encoding an active β-ketoacyl-ACP synthase I and express a product of an exogenous gene encoding an active acyl-ACP thioesterase.

Another aspect of the present invention provides a food comprising an oil as discussed above.

These and other aspects and embodiments of the invention are described in the accompanying drawing, a brief description of which immediately follows, the detailed description of the invention below, and are exemplified in the examples below. Any or all of the features discussed above and throughout the application can be combined in various embodiments of the present invention.

DETAILED DESCRIPTION OF THE INVENTION

Figure 1:
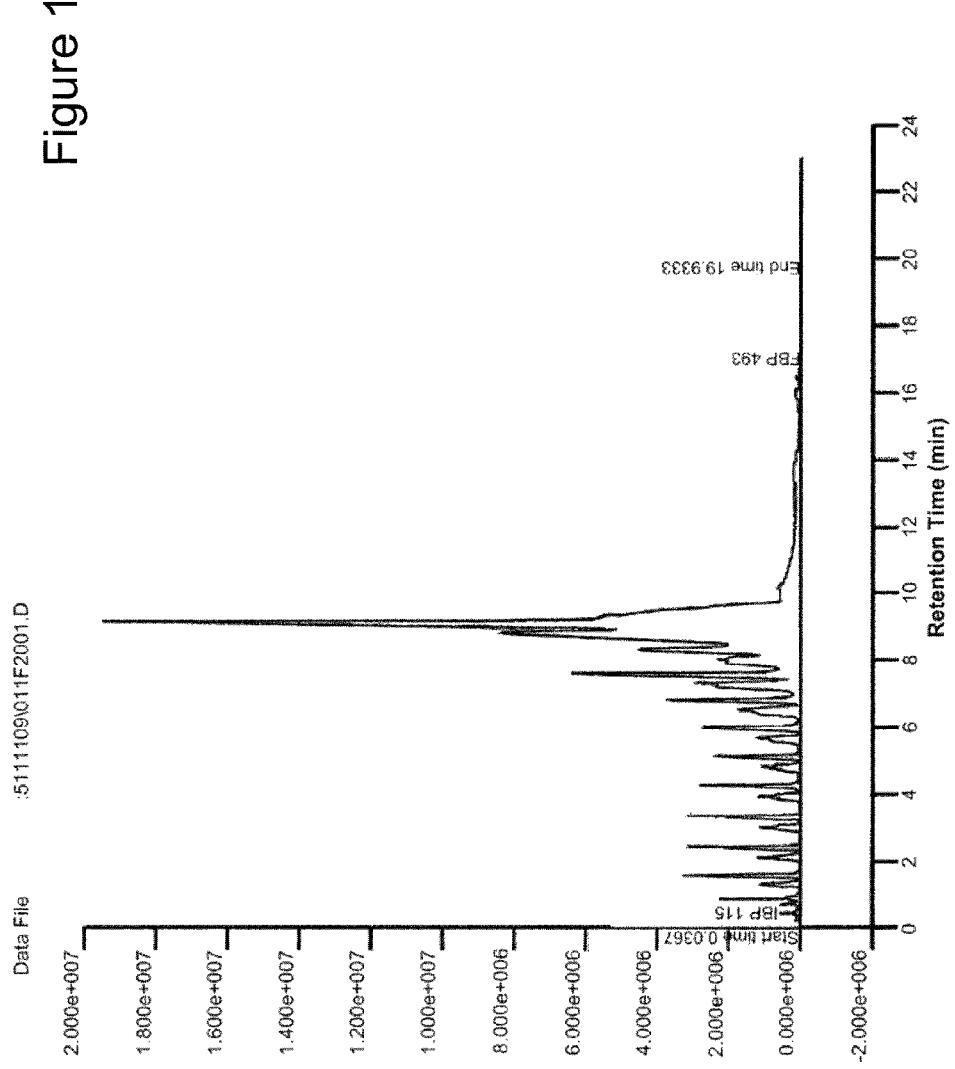
FIG. 1 shows a chromatogram of renewable diesel produced from *Prototheca* triglyceride oil.

Illustrative embodiments of the present invention feature oleaginous cells that produce altered glycerolipid profiles and products produced from the cells. Examples of oleaginous cells include microbial cells having a type II lipid biosynthesis pathway. Embodiments include recombinant cells expressing one or more exogenous genes encoding proteins such as fatty acyl-ACP thioesterases, fatty acid destaturases, keto-acyl syntheases and optionally having one or more knockdowns of endogenous genes encoding proteins with similar activities. As a result, some embodiments feature natural oils never before obtainable. The present invention also provides methods of making lipids and oil-based products, including fuels such as biodiesel, renewable diesel and jet fuel, food oils and chemicals from such cells.

The oils produced according to embodiments of the present invention can be used in the transportation fuel, oleochemical, and/or food and cosmetic industries, among other applications. For example, transesterification of lipids can yield long-chain fatty acid esters useful as biodiesel. Other enzymatic and chemical processes can be tailored to yield fatty acids, aldehydes, alcohols, alkanes, and alkenes. In some applications, renewable diesel, jet fuel, or other hydrocarbon compounds are produced. The present invention also provides methods of cultivating microalgae for increased productivity and increased lipid yield, and/or for more cost-effective production of the compositions described herein.

An embodiment of the invention provides a method for producing a natural oil comprising triacylglycerides, or for producing a product produced from the natural oil. The natural oil can be a non-plant or non-seed oil. The method comprises cultivating a cell of a recombinant microorganism to produce a tailored oil; i.e., one with an altered fatty acid profile due to the presence of the recombinant nucleic acids in the cell. The natural oil can then be further processed to produce a food, fuel, or chemical product. The recombinant nucleic acids in the cell are operable to (a) decrease or eliminate the expression of an enzyme encoded by one or more genes that encode a β-ketoacyl-ACP synthase I, β-ketoacyl-ACP synthase II, stearoyl ACP desaturase, fatty acid desaturase, or acyl-ACP thioesterase. Optionally the cell comprises recombinant nucleic acids operable to decrease or eliminate the expression of two copies of a gene (e.g., two alleles in a diploid organism) encoding a β-ketoacyl-ACP synthase I, β-ketoacyl-ACP synthase II, stearoyl ACP desaturase, or fatty acid desaturase, or acyl-ACP thioesterase; or (b) express a product of a exogenous gene encoding an active β-ketoacyl-ACP synthase I, β-ketoacyl-ACP synthase II, stearoyl ACP desaturase, or fatty acid desaturase, or acyl-ACP thioesterase; or (c) decrease or eliminate the expression of an enzyme encoded by one or more genes that encode a β-ketoacyl-ACP synthase I or β-ketoacyl-ACP synthase II, and express a product of a exogenous gene encoding an active stearoyl ACP desaturase, fatty acid desaturase, or acyl-ACP thioesterase; or (d) decrease or eliminate the expression of an enzyme encoded by one or more genes that encode a stearoyl ACP desaturase or fatty acid desaturase, and express a product of an exogenous gene encoding an active β-ketoacyl-ACP synthase I, β-ketoacyl-ACP synthase II, or acyl-ACP thioesterase.

Where a recombinant nucleic acid encoding one or more fatty acid desturases is present in the cell, the nucleic acid may encode for one or more of a ω-6 fatty acid desaturase, a ω-3 fatty acid desaturase, or a ω-6 oleate desaturase, or a delta 12 fatty acid desaturase.

Where the cell comprises recombinant nucleic acids operable to decrease or eliminate the expression of an enzyme, this may occur through expression of antisense, RNAi, or dsRNA targeting the transcript of a gene encoding for the enzyme, or by other suitable means, including a directed mutation, complete deletion, or partial deletion. Thus, the decrease or alimentation of the expression of an enzyme encoded by one or more genes that encode a β-ketoacyl-ACP synthase I, β-ketoacyl-ACP synthase II, stearoyl ACP desaturase, or fatty acid desaturase can be due to the interruption or replacement of the one or more genes with one or more genes encoding an active β-ketoacyl-ACP synthase I, β-ketoacyl-ACP synthase II, stearoyl ACP desaturase, or fatty acid desaturase, or acyl-ACP thioesterase.

Preferably, the recombinant nucleic acids are stably integrated into the cell; e.g., into the cells chromosome, or an episome. The selection of cells with stably integrated nucleic acids may be aided using a selectable marker such as sucrose invertase, an antibiotic resistance gene, or thiamine auxotrophy complementation, as described herein.

Preferably, the microorganism can be one that synthesizes fatty acids through a type II fatty acid biosynthesis pathway. For example, the microorganism can be a microalga, but can also be a microorganism that normally possesses a type I fatty acid biosynthetic pathway (e.g., an oil producing yeast) into which type two genetic machinery has been introduced using genetic engineering techniques. The microorganism can be a heterotroph, and in a specific embodiment, an obligate heterotroph. Where the microalga is used, the microalga may be a species of *Prototheca* or *Chlorella*. Illustrative species include *Prototheca wickerhamii, Prototheca stagnora, Prototheca portoricensis, Prototheca moriformis, Prototheca zopfii, Chlorella kessleri, Chlorella luteoviridis Chlorella protothecoides*, and *Chlorella vulgaris*. In order to be able to use sucrose feedstocks such as sugar cane juice and others described herein, the recombinant cell can include recombinant nucleic acids that include a sucrose invertase gene so as to express an active sucrose invertase. The sucrose invertase may be secreted by the microorganism into the medium.

Cultivation can be heterotrophic; e.g., performed in a bioreactor using a fixed carbon source such as glucose or sucrose. The cultivation may be continued until the cell reaches at least 50%, at least 60%, at least 70%, or 50 to 90% triglyceride by dry cell weight. This may entail cultivation using limiting nitrogen, as described infra.

The oil produced by the cell can be extracted from the cell. In an embodiment, the oil comprises less than 500, 50, or 5 ppm of colored molecules. Optionally, the oil is analyzed for its fatty acid profile; e.g., by LC-MS. The oil can also have one or more of the properties of the oil of Example 19, tables 60-63.

In a specific embodiment, the recombinant cell comprises nucleic acids operable to decrease or eliminate the expression of a β-ketoacyl-ACP synthase II encoded by a KASII gene, and to express a product of an exogenous gene encoding an acyl-ACP thioesterase. As a result, the cell can produce an oil with a fatty acid profile characterized by having at least 40, 50, 60, or 70% C16 fatty acids (e.g., palmitic acid). Thus, the oil can have a fatty acid distribution shifted towards shorter chain lengths. The shift in the fatty acid distribution can be characterized by a reduced mean fatty acid length or other statistical characterization of the distribution. For example, to calculate mean fatty acid length, the percent of each detectable fatty acid making up the triglycerides is multiplied by the number of carbons in the fatty acid and the sum of the products is divided by 100. The exogenous gene encoding the acyl-ACP thioesterase can produce an active acyl-ACP thioesterase having greater activity in hydrolysis of C8-C16 fatty acyl chains than a native acyl-ACP-thioesterase of the cell. The exogenous gene encoding an acyl-ACP thioesterase can interrupt the KASII gene. In this way, the insertion of the acyl-ACP thioesterase can also eliminate expression of the β-ketoacyl-ACP synthase II in one step. See Examples 15 and 16.

In another specific embodiment, the recombinant cell comprises nucleic acids operable to decrease or eliminate the expression of an enzyme encoded by one or more genes that encode a β-ketoacyl-ACP synthase I. As a result, the oil produced has a fatty acid profile characterized by a distribution of fatty acid chain lengths that is shorter than a comparable cell lacking the recombinant nucleic acids. This may be expressed as a reduced mean fatty acid chain length. The recombinant cell can include nucleic acids operable to decrease or eliminate the expression of a fatty acid desaturase encoded by at least one FAD gene and to express a product of a stearoyl-ACP desaturase exogenous gene encoding an active stearoyl ACP desaturase. Optionally, the nucleic acids are operable to decrease or eliminate the expression of a fatty acid desaturase encoded by multiple copies (e.g., alleles) of a fatty acid desaturase gene. In a specific embodiment, the stearoyl-ACP desaturase exogenous gene is recombined into a locus within the coding region of the fatty acid desaturase gene. As a result, the oil produced can have an elevated level of oleic acid compared to that produced by a comparable cell lacking the nucleic acids. The oleic acid comprises at least 50, 60, 70, 80, or 90% of the fatty acids in the fatty acid profile. See Example 10.

In another specific embodiment, the recombinant cell comprises nucleic acids operable to express a product of a β-ketoacyl-ACP synthase II exogenous gene encoding an active β-ketoacyl-ACP synthase II. As a result, the oil produced can be characterized by a fatty acid profile elevated in 18:1 fatty acids and reduced in C16 fatty acids as a result of the recombinant nucleic acids. See Example 13, in which overexpression of a KASII gene increased the percentage of C18 fatty acids from about 68% in the untransformed cells to about 84%. In related embodiments, the increase is greater than 70%, from 75-85%, or from 70-90%.

In another specific embodiment, the recombinant cell comprises nucleic acids operable to decrease or eliminate the expression of an enzyme encoded by one or more genes that encode a stearoyl ACP desaturase by RNA interference. As a result, the oil produced can have a fatty acid profile characterized by an increase in 18:0 fatty acids. The 18:0 fatty acids can be at least 50, 60, 70, 80, or 90% of the fatty acids in the profile. See Example 12.

In another specific embodiment, the cell comprises recombinant nucleic acids operable to decrease or eliminate the expression of two copies of a gene (e.g. two alleles) encoding a β-ketoacyl-ACP synthase I, β-ketoacyl-ACP synthase II, stearoyl ACP desaturase, or fatty acid desaturase. See Example 14, in which an endogenous KASI allele was knocked out in *Prototheca*. As a result, an increase was observed in the percentage of total C14 fatty acids by about 35% to 400% and the percentage of C16 fatty acids by about 30 to 50% due to disruption of an endogenous KASI.

In another specific embodiment, the cell comprises recombinant nucleic acids operable to express a product of a fatty acid desaturase exogenous gene encoding an active a ω-3 fatty acid desaturase and/or a ω-6 oleate desaturase. As a result, elevated levels of linoleic acid, linolenic acid, or both can be produced by the cell, and detected in the fatty acid profile of the cell lipids. For example, the cell can have at least 10, 20, 30, 40, or 50% linoleic acid, linolenic acid, or both. For example, a recombinant 415 desaturase enzyme may be expressed as in Example 11. As a result, C18:3 fatty acids (i.e., linolenic acid), can be increased from about 2 to 17 fold, or more.

In another embodiment, a cell of a recombinant microorganism is cultivated. The cell includes recombinant nucleic acids that operate to express a product of an exogenous gene encoding an active oleate 12-hydroxylase, so as to synthesize the ricinoleic acid. This gene may be present in any of the aforementioned embodiments. See Example 7. A preferred substrate for 12-hydroxylase is oleic acid. Thus, in a preferred embodiment, a higher yield of ricinoleic acid may be obtained by inclusion in the cell of recombinant nucleic acids that operate to increase oleic acid production. Without limitation, the cell comprises recombinant nucleic acids operable to express a product of an exogenous gene encoding an active stearoyl ACP desaturase and decrease or eliminate the expression of an enzyme encoded by one or more genes that encode a fatty acid desaturase; or express a product of an exogenous gene encoding an active β-ketoacyl-ACP synthase I and express a product of an exogenous gene encoding an active acyl-ACP thioesterase.

In accordance with any of the embodiments of the invention, the oil can be extracted and further processed by one or more of refining, bleaching, deodorizing, metathesis, transesterification, hydrogenation, hydrolysis, hydrogenation, deoxygenation, hydrocracking, isomerization, hydroxylation, interesterification, amidation, sulfonation, and sulfurization. The oil may be processed, for example, to create a food oil, fatty acids, a fatty alcohol, a lubricant, a soap, a fatty acid ester, a fatty acid ethoxylate, a fatty amine, an alkyl chloride, a fatty alcohol ethoxylate, a fatty alcohol sulfate, a fatty acid alkanolamide, a sulfonated oil, or a sulfurized oil, diesel, jet gasoline, or a blendstock or additive, a lubricant, or a paint.

Any of the embodiments mentioned herein can be useful as a food or food oil. The whole organism can be incorporated into a food. The organism can be intact, partly lysed, mostly lysed or entirely lysed. Methods for preparing and using oleaginous organisms in food is taught in WO2011/150411, WO2010/12093, WO2011130578, and WO2011/130576. Alternately, the extracted and optionally purified oil from the organism can be used as food oil, including as a food oil ingredient in prepared foods such as spreads, sauces, confections, and frozen confections. In a specific embodiment, the oleaginous cells or food oil comprise 50-70% C18:0 and 20-40% 18:1 (e.g., oleate). In another specific embodiment, the oleaginous cells or food oil comprises 50-70% C16:0 and 20-40% 18:1 (e.g., oleate).

This detailed description of the invention is divided into sections for the convenience of the reader. Section I provides definitions of terms used herein. Section II provides a description of culture conditions useful in the methods of the invention. Section III provides a description of genetic engineering methods and materials. Section IV provides a description of genetic engineering to enable sucrose utilization. Section V provides a description of genetic engineering to modify lipid biosynthesis. Section VI describes methods for making fuels and chemicals. Section VII discloses examples and embodiments of the invention. The detailed description of the invention is followed by examples that illustrate the various aspects and embodiments of the invention.

I. DEFINITIONS

Unless defined otherwise, all technical and scientific terms used herein have the meaning commonly understood by a person skilled in the art to which this invention belongs. As used herein, the following terms have the meanings ascribed to them unless specified otherwise.

"Active in microalgae" refers to a nucleic acid that is functional in microalgae. For example, a promoter that has been used to drive an antibiotic resistance gene to impart antibiotic resistance to a transgenic microalgae is active in microalgae.

"Area Percent" refers to the area of peaks observed using FAME GC/FID detection methods in which every fatty acid in the sample is converted into a fatty acid methyl ester (FAME) prior to detection. For example, a separate peak is observed for a fatty acid of 14 carbon atoms with no unsaturation (C14:0) compared to any other fatty acid such as C14:1. The peak area for each class of FAME is directly proportional to its percent composition in the mixture and is calculated based on the sum of all peaks present in the sample (i.e. [area under specific peak/total area of all measured peaks]×100). When referring to lipid profiles of oils and cells of the invention, "at least 4% C8-C14" means that at least 4% of the total fatty acids in the cell or in the extracted glycerolipid composition have a chain length that includes 8, 10, 12 or 14 carbon atoms.

"Axenic" is a culture of an organism free from contamination by other living organisms.

"Biodiesel" is a biologically produced fatty acid alkyl ester suitable for use as a fuel in a diesel engine.

"Biomass" is material produced by growth and/or propagation of cells. Biomass may contain cells and/or intracellular contents as well as extracellular material, includes, but is not limited to, compounds secreted by a cell.

"Bioreactor" is an enclosure or partial enclosure in which cells are cultured, optionally in suspension.

"Cellulosic material" is a biological material comprising cellulose and optionally hemicellulose. As such it is digestible to sugars such as glucose and xylose, and optionally may comprise additional compounds such as disaccharides, oligosaccharides, lignin, furfurals and other compounds. Non-limiting examples of sources of cellulosic material include sugar cane bagasses, sugar beet pulp, corn stover, wood chips, sawdust and switchgrass.

"Co-culture", and variants thereof such as "co-cultivate" and "co-ferment", refer to cultivating two or more types of cells in the same bioreactor. The two or more types of cells may both be microorganisms, such as microalgae, or may be a microalgal cell cultured with a different cell type.

"Colored molecules" or "color generating impurities" as used herein refer to any compound that imparts a color to the extracted oil. "Colored molecules" or "color generating impurities" include for example, chlorophyll a, chlorophyll b, lycopenes, tocopherols, campesterols, tocotrienols, and carotenoids, such as beta carotene, luteins, zeaxanthin, astaxanthin. These molecules are preferably present in the microbial biomass or the extracted oil at a concentration of no more than 500 ppm, no more than 250 ppm, no more than 100 ppm, no more than 75 ppm, or no more than 25 ppm. In other embodiments, the amount of chlorophyll that is present in the microbial biomass or the extracted oil is less than 500 mg/kg, less than 100 mg/kg, less than 10 mg/kg, less than 1 mg·kg, less than 0.5 mg/kg, less than 0.1 mg/kg, less than 0.05 mg/kg, or less than 0.01 mg/kg.

"Cultivated", and variants thereof such as "cultured" and "fermented", refer to the intentional fostering of growth (increases in cell size, cellular contents, and/or cellular activity) and/or propagation (increases in cell numbers) of one or more cells by use of selected and/or controlled conditions. The combination of both growth and propagation is termed "proliferation." Examples of selected and/or controlled conditions include the use of a defined medium (with known characteristics such as pH, ionic strength, and carbon source), specified temperature, oxygen tension, carbon dioxide levels, and growth in a bioreactor. "Cultivated" does not refer to the growth or propagation of microorganisms in nature or otherwise without human intervention; for example, natural growth of an organism that ultimately becomes fossilized to produce geological crude oil is not cultivation.

"Desaturase" refers to an enzyme in the lipid synthesis pathway responsible for the introduction of double bonds (unsaturation) into the fatty acid chains of triacylglyceride molecules. Examples include but are not limited to stearoyl-Acyl carrier protein desaturase (SAD) and fatty acid desaturase (FAD), also known as fatty acyl desaturase.

"Expression vector" or "expression construct" or "plasmid" or "recombinant DNA construct" is a vehicle for introducing a nucleic acid into a host cell. The nucleic acid can be one that has been generated via human intervention, including by recombinant means or direct chemical synthesis, with a series of specified nucleic acid elements that permit transcription and/or translation of a particular nucleic acid. The expression vector can be part of a plasmid, virus, or nucleic acid fragment, or other suitable vehicle. Typically, the expression vector includes a nucleic acid to be transcribed operably linked to a promoter.

"Exogenous gene" is a nucleic acid that codes for the expression of an RNA and/or protein that has been introduced into a cell (e.g. by transformation/transfection), and is also referred to as a "transgene". A cell comprising an exogenous gene may be referred to as a recombinant cell, into which additional exogenous gene(s) may be introduced. The exogenous gene may be from a different species (and so heterologous), or from the same species (and so homologous), relative to the cell being transformed. Thus, an exogenous gene can include a homologous gene that occupies a different location in the genome of the cell or is under different control, relative to the endogenous copy of the gene. An exogenous gene may be present in more than one copy in the cell. An exogenous gene may be maintained in a cell as an insertion into the genome (nuclear or plastid) or as an episomal molecule.

"Exogenously provided" refers to a molecule provided to the culture media of a cell culture.

Depending on the context, "fatty acids" shall mean free fatty acids, fatty acid salts, or fatty acyl moieties in a glycerolipid.

"Fixed carbon source" is a molecule(s) containing carbon, typically an organic molecule, that is present at ambient temperature and pressure in solid or liquid form in a culture media that can be utilized by a microorganism cultured therein. Accordingly, carbon dioxide is not a fixed carbon source.

"Heterotrophic" as it pertains to culture conditions is culturing in the substantial absence of light while utilizing or metabolizing a fixed carbon source.

"Homogenate" is biomass that has been physically disrupted.

"Hydrogen:carbon ratio" is the ratio of hydrogen atoms to carbon atoms in a molecule on an atom-to-atom basis. The ratio may be used to refer to the number of carbon and hydrogen atoms in a hydrocarbon molecule. For example, the hydrocarbon with the highest ratio is methane $CH_4$ (4:1).

"Inducible promoter" is a promoter that mediates transcription of an operably linked gene in response to a particular stimulus. Examples of such promoters may be promoter sequences that are induced in conditions of changing pH or nitrogen levels.

"In operable linkage" is a functional linkage between two nucleic acid sequences, such a control sequence (typically a promoter) and the linked sequence (typically a sequence that encodes a protein, also called a coding sequence). A promoter is in operable linkage with an exogenous gene if it can mediate transcription of the gene.

"Lipid modification enzyme" refers to an enzyme that alters the covalent structure of a lipid or can otherwise lead to an altered fatty acid profile in a cell. Examples of lipid modification enzymes include a lipase, a fatty acyl-ACP thioesterase, a fatty acyl-CoA/aldehyde reductase, a fatty acyl-CoA reductase, a fatty aldehyde reductase, a desaturase, including a stearoyl acyl carrier protein desaturase (SAD) and a fatty acyl desaturase (FAD), and a fatty aldehyde decarbonylase.

"Lipid pathway enzyme" is any enzyme that plays a role in lipid metabolism, i.e., either lipid synthesis, modification, or degradation, and any proteins that chemically modify lipids, as well as carrier proteins.

"Lipid profile" or "glycerolipid profile" refers to the distribution of fatty acids in a cell or oil derived from a cell in terms of chain length and/or saturation pattern. In this context the saturation pattern can comprise a measure of saturated versus unsaturated acid or a more detailed analysis of the distribution of the positions of double bonds in the various fatty acids of a cell.

"Lysis" is the breakage of the plasma membrane and optionally the cell wall of a biological organism sufficient to release at least some intracellular content, often by mechanical, chemical, viral or osmotic mechanisms that compromise its integrity.

"Lysing" is the process of lysis.

"Microalgae" is a microbial organism that contains a chloroplast or plastid, and optionally that is capable of performing photosynthesis, or a prokaryotic microbial organism capable of performing photosynthesis. Microalgae include obligate photoautotrophs, which cannot metabolize a fixed carbon source as energy, as well as heterotrophs, which can live solely off of a fixed carbon source. Microalgae include unicellular organisms that separate from sister cells shortly after cell division, such as *Chlamydomonas*, as well as microbes such as, for example, *Volvox*, which is a simple multicellular photosynthetic microbe of two distinct cell types. Microalgae include cells such as *Chlorella, Dunaliella*, and *Prototheca*. Microalgae also include other microbial photosynthetic organisms that exhibit cell-cell adhesion, such as *Agmenellum, Anabaena*, and *Pyrobotrys*. Microalgae also include obligate heterotrophic microorganisms that have lost the ability to perform photosynthesis, such as certain dinoflagellate algae species and species of the genus *Prototheca*.

"Mid chain", as used herein in the context of fatty acids, refers to a C10-C16 fatty acid. "Short chain", in this context, refers to C6-C10 fatty acids, while "long chain" refers to C17 or longer fatty acids. These boundaries are not intended to be precisely defined, unless otherwise indicated.

A "natural oil" shall mean a predominantly triglyceride oil obtained from an organism, where the oil has not undergone blending with another natural or synthetic oil, or fractionation so as to substantially alter the fatty acid profile of the triglyceride. Here, the term "fractionation" means removing material from the oil in a way that changes its fatty acid profile relative to the profile produced by the organism, however accomplished. A natural oil encompasses such an oil obtained from an organism, where the oil has undergone minimal processing, including refining, bleaching and/or degumming, that does not substantially change its triglyceride profile. A natural oil can also be a "noninteresterified natural oil", which means that the natural oil has not undergone a process in which fatty acids have been redistributed in their acyl linkages to glycerol and remain essentially in the same configuration as when recovered from the organism.

"Naturally co-expressed" with reference to two proteins or genes means that the proteins or their genes are co-expressed naturally in a tissue or organism from which they are derived, e.g., because the genes encoding the two proteins are under the control of a common regulatory sequence or because they are expressed in response to the same stimulus.

"Osmotic shock" is the rupture of cells in a solution following a sudden reduction in osmotic pressure. Osmotic shock is sometimes induced to release cellular components of such cells into a solution.

"Polysaccharide-degrading enzyme" is any enzyme capable of catalyzing the hydrolysis, or saccharification, of any polysaccharide. For example, cellulases catalyze the hydrolysis of cellulose.

"Polysaccharides" or "glycans" are carbohydrates made up of monosaccharides joined together by glycosidic linkages. Cellulose is a polysaccharide that makes up certain plant cell walls. Cellulose can be depolymerized by enzymes to yield monosaccharides such as xylose and glucose, as well as larger disaccharides and oligosaccharides.

"Promoter" is a nucleic acid control sequence that directs transcription of a nucleic acid. As used herein, a promoter includes necessary nucleic acid sequences near the start site of transcription, such as, in the case of a polymerase II type promoter, a TATA element. A promoter also optionally includes distal enhancer or repressor elements, which can be located as much as several thousand base pairs from the start site of transcription.

"Recombinant" is a cell, nucleic acid, protein or vector, that has been modified due to the introduction of an exogenous nucleic acid or the alteration of a native nucleic acid. Thus, e.g., recombinant cells can express genes that are not found within the native (non-recombinant) form of the cell or express native genes differently than those genes are expressed by a non-recombinant cell. Recombinant cells can, without limitation, include recombinant nucleic acids that encode for a gene product or for suppression elements such as mutations, knockouts, antisense, interfering RNA (RNAi) or dsRNA that reduce the levels of active gene product in a cell. A "recombinant nucleic acid" is a nucleic acid originally formed in vitro, in general, by the manipulation of nucleic acid, e.g., using polymerases, ligases, exonucleases, and endonucleases, or otherwise is in a form not normally found in nature. Recombinant nucleic acids may be produced, for example, to place two or more nucleic acids in operable linkage. Thus, an isolated nucleic acid or an expression vector formed in vitro by ligating DNA molecules that are not normally joined in nature, are both considered recombinant for the purposes of this invention. Once a recombinant nucleic acid is made and introduced into a host cell or organism, it may replicate using the in vivo cellular machinery of the host cell; however, such nucleic acids, once produced recombinantly, although subsequently replicated intracellularly, are still considered recombinant for purposes of this invention. Similarly, a "recombinant protein" is a protein made using recombinant techniques, i.e., through the expression of a recombinant nucleic acid.

"Renewable diesel" is a mixture of alkanes (such as C10:0, C12:0, C14:0, C16:0 and C18:0) produced from a natural oil; e.g., through hydrogenation and deoxygenation of lipids.

"Saccharification" is a process of converting biomass, usually cellulosic or lignocellulosic biomass, into monomeric sugars, such as glucose and xylose. "Saccharified" or "depolymerized" cellulosic material or biomass refers to cellulosic material or biomass that has been converted into monomeric sugars through saccharification.

"Species of *furfural*" is 2-furancarboxaldehyde or a derivative that retains the same basic structural characteristics.

In connection with transformation of a strain to create a recombinant strain in accordance with embodiments herein (and not necessarily to discussions of prior art), "stable" or "stably integrated" shall mean that the recombinant nucleic acids are retained by the cells of the strain for at least 10 generations. For example, where a recombinant strain has a selectable marker that enables cultivation in the presence of a selection pressure, the recombinant nucleic acids are retained after 10 generations of cultivation in the absence of the selection pressure.

"Sucrose utilization gene" is a gene that, when expressed, aids the ability of a cell to utilize sucrose as an energy source. Proteins encoded by a sucrose utilization gene are referred to herein as "sucrose utilization enzymes" and include sucrose transporters, sucrose invertases, and hexokinases such as glucokinases and fructokinases.

II. CULTIVATION

The present invention generally relates to cultivation of microorganisms, and particularly oleaginous microorganisms having a type II fatty acid biosynthesis pathway, such as microalgae to produce triglycerides. In an embodiment, the microorganisms are obligate heterotrophs. The microorganisms may be recombinant microorganims based, for example, of the genetic engineering methods disclosed infra. For the convenience of the reader, this section is subdivided into subsections. Subsection 1 describes species and strains of microorganisms. Subsection 2 describes bioreactors useful for cultivation. Subsection 3 describes media for cultivation. Subsection 4 describes oil production in accordance with illustrative cultivation methods of the invention.

1. Microorganism Species and Strains

Although the illustrative embodiments presented below are applicable to numerous microorganisms, *Prototheca* is a preferred microorganism for use in the production of lipid. Importantly, the genetic engineering methods described herein with *Prototheca* as an example are applicable to other microorganisms (e.g., *Chlorella sorokiniana, Chlorella vulgaris Chlorella ellipsoidea, Chlorella kessleri, Dunaliella tertiolecta, Volvox carteri, Haematococcus pluvialis, Closterium peracerosum-strigosum-littorale complex, Dunaliella viridis, Dunaliella sauna, Gonium pectorale, Phaeodactylum tricornutum, Chaetoceros, Cylindrotheca fusiformis, Amphidinium* sp., *Symbiodinium microadriacticum, Nannochloropsis, Cyclotella cryptica, Navicula saprophila*, or *Thalassiosira pseudonana*).

Lipid or oil obtained from an obligate heterotrophic microalgae such as *Prototheca* can be generally low in pigment (e.g., low to undetectable levels of chlorophyll and certain carotenoids, for example less than 500, 50 or 5 ppm, of colored molecules, color-generating impurities, or the sum of chlorophyll and carotenoid concentrations) and in any event contains much less pigment than lipid from other microalgae. Moreover, recombinant *Prototheca* cells provided by the invention can be used to produce lipid in greater yield and efficiency, and with reduced cost, relative to the production of lipid from other microorganisms. Illustrative *Prototheca* strains for use in the methods of the invention include In addition, this microalgae grows heterotrophically and can be genetically engineered as *Prototheca wickerhamii, Prototheca stagnora* (including UTEX 327), *Prototheca portoricensis, Prototheca moriformis* (including UTEX strains 1441, 1435), and *Prototheca zopfii*. Species of the genus *Prototheca* are obligate heterotrophs.

Considerations affecting the selection of microorganisms for use in embodiments of the invention include, in addition to production of suitable lipids or hydrocarbons for production of oils, fuels, and oleochemicals: (1) high lipid content as a percentage of cell weight; (2) ease of growth; (3) ease of genetic engineering; and (4) ease of biomass processing. In particular embodiments, the wild-type or genetically engineered microorganism yields cells that are at least 40%, at least 45%, at least 50%, at least 55%, at least 60%, at least 65%, or at least 70% or more lipid. In other particular embodiments, the wild-type or genetically engineered microorganism yields cells that comprise between 40 and 80% or 50 and 90% triglyceride. Preferred organisms grow heterotrophically (on sugars in the absence of light).

Examples of algae that can be used to practice the present invention include, but are not limited to the following algae listed in Table 1.

TABLE 1

Examples of algae.

*Achnanthes orientalis, Agmenellum, Amphiprora hyaline, Amphora coffeiformis, Amphora coffeiformis linea, Amphora coffeiformis punctata, Amphora coffeiformis taylori, Amphora coffeiformis tenuis, Amphora delicatissima, Amphora delicatissima capitata, Amphora* sp., *Anabaena, Ankistrodesmus, Ankistrodesmus falcatus, Boekelovia hooglandii, Borodinella* sp., *Botryococcus braunii, Botryococcus sudeticus, Carteria, Chaetoceros gracilis, Chaetoceros muelleri, Chaetoceros muelleri subsalsum, Chaetoceros* sp., *Chlorella anitrata, Chlorella Antarctica, Chlorella aureoviridis, Chlorella candida, Chlorella capsulate, Chlorella desiccate, Chlorella ellipsoidea, Chlorella emersonii, Chlorella fusca, Chlorella fusca* var. *vacuolata, Chlorella glucotropha, Chlorella infusionum, Chlorella infusionum* var. *actophila, Chlorella infusionum* var. *auxenophila, Chlorella kessleri, Chlorella lobophora* (strain SAG 37.88), *Chlorella luteoviridis, Chlorella luteoviridis* var. *aureoviridis, Chlorella luteoviridis* var. *lutescens, Chlorella miniata, Chlorella minutissima, Chlorella mutabilis, Chlorella nocturna, Chlorella parva, Chlorella photophila, Chlorella pringsheimii, Chlorella protothecoides* (including any of UTEX strains 1806, 411, 264, 256, 255, 250, 249, 31, 29, 25, and CCAP strains 211/17 and 211/8d), *Chlorella protothecoides* var. *acidicola, Chlorella regularis, Chlorella regularis* var. *minima, Chlorella regularis* var. *umbricata, Chlorella reisiglii, Chlorella saccharophila, Chlorella saccharophila* var. *ellipsoidea, Chlorella salina, Chlorella* simplex, *Chlorella sorokiniana, Chlorella* sp., *Chlorella sphaerica, Chlorella stigmatophora, Chlorella* vanniellii, *Chlorella vulgaris, Chlorella vulgaris, Chlorella vulgaris f. tertia, Chlorella vulgaris* var. *autotrophica, Chlorella vulgaris* var. *viridis, Chlorella vulgaris* var. *vulgaris, Chlorella vulgaris* var. *vulgaris f. tertia, Chlorella vulgaris* var. *vulgaris f. viridis, Chlorella xanthella, Chlorella zofingiensis, Chlorella* trebouxioides, *Chlorella vulgaris, Chlorococcum infusionum, Chlorococcum* sp., *Chlorogonium, Chroomonas* sp., *Chrysosphaera* sp., *Cricosphaera* sp., *Cryptomonas* sp., *Cyclotella cryptica, Cyclotella meneghiniana, Cyclotella* sp., *Dunaliella* sp., *Dunaliella* bardawil, *Dunaliella bioculata, Dunaliella* granulate, *Dunaliella* maritime, *Dunaliella minuta, Dunaliella parva, Dunaliella peircei, Dunaliella primolecta, Dunaliella salina, Dunaliella terricola, Dunaliella tertiolecta, Dunaliella viridis, Dunaliella tertiolecta, Eremosphaera viridis, Eremosphaera* sp., Ellipsoidon sp., *Euglena, Franceia* sp., *Fragilaria crotonensis, Fragilaria* sp., Gleocapsa sp., Gloeothamnion sp., Hymenomonas sp., *Isochrysis aff. galbana, Isochrysis galbana, Lepocinclis, Micractinium, Micractinium* (UTEX LB 2614), *Monoraphidium minutum, Monoraphidium* sp., *Nannochloris* sp., *Nannochloropsis* salina, *Nannochloropsis* sp., *Navicula* acceptata, *Navicula* biskanterae, *Navicula* pseudotenelloides, *Navicula pelliculosa, Navicula* saprophila, *Navicula* sp., *Nephrochloris* sp., *Nephroselmis* sp., *Nitschia communis, Nitzschia* alexandrina, *Nitzschia communis, Nitzschia dissipata, Nitzschia frustulum, Nitzschia* hantzschiana, *Nitzschia inconspicua, Nitzschia* intermedia, *Nitzschia microcephala,*

TABLE 1-continued

Examples of algae.

*Nitzschia pusilla, Nitzschia pusilla elliptica, Nitzschia pusilla monoensis, Nitzschia quadrangular, Nitzschia* sp., *Ochromonas* sp., *Oocystis* parva, *Oocystis pusilla, Oocystis* sp., *Oscillatoria* limnetica, *Oscillatoria* sp., *Oscillatoria subbrevis*, Pascheria *acidophila, Pavlova* sp., *Phagus, Phormidium, Platymonas* sp., *Pleurochrysis carterae, Pleurochrysis dentate, Pleurochrysis* sp., *Prototheca* wickerhamii, *Prototheca stagnora, Prototheca portoricensis, Prototheca moriformis, Prototheca zopfii, Pyramimonas* sp., *Pyrobotrys*, Sarcinoid *chrysophyte, Scenedesmus* armatus, *Spirogyra, Spirulina platensis, Stichococcus* sp., *Synechococcus* sp., *Tetraedron, Tetraselmis* sp., *Tetraselmis suecica, Thalassiosira* weissflogii, and *Viridiella* fridericiana 2. Bioreactor Microorganisms are cultured both for purposes of conducting genetic manipulations and for production of hydrocarbons (e.g., lipids, fatty acids, aldehydes, alcohols, and alkanes). The former type of culture is conducted on a small scale and initially, at least, under conditions in which the starting microorganism can grow. Culture for purposes of hydrocarbon production is usually conducted on a large scale (e.g., 10,000 L, 40,000 L, 100,000 L or larger bioreactors) in a bioreactor. Microalgae, including *Prototheca* species are typically cultured in the methods of the invention in liquid media within a bioreactor. Typically, the bioreactor does not allow light to enter.

The bioreactor or fermentor is used to culture microalgal cells through the various phases of their physiological cycle. Bioreactors offer many advantages for use in heterotrophic growth and propagation methods. To produce biomass, microalgae are preferably fermented in large quantities in liquid, such as in suspension cultures. Bioreactors such as steel fermentors can accommodate very large culture volumes (40,000 liter and greater capacity bioreactors are used in various embodiments of the invention). Bioreactors also typically allow for the control of culture conditions such as temperature, pH, oxygen tension, and carbon dioxide levels. For example, bioreactors are typically configurable, for example, using ports attached to tubing, to allow gaseous components, like oxygen or nitrogen, to be bubbled through a liquid culture. Other culture parameters, such as the pH of the culture media, the identity and concentration of trace elements, and other media constituents can also be more readily manipulated using a bioreactor.

Bioreactors equipped with devices such as spinning blades and impellers, rocking mechanisms, stir bars, means for pressurized gas infusion can be used to subject cultures to mixing. Mixing may be continuous or intermittent. For example, in some embodiments, a turbulent flow regime of gas entry and media entry is not maintained for reproduction of cells until a desired increase in number of said cells has been achieved.

Bioreactor ports can be used to introduce, or extract, gases, solids, semisolids, and liquids, into the bioreactor chamber containing the microalgae. While many bioreactors have more than one port (for example, one for media entry, and another for sampling), it is not necessary that only one substance enter or leave a port. For example, a port can be used to flow culture media into the bioreactor and later used for sampling, gas entry, gas exit, or other purposes. Preferably, a sampling port can be used repeatedly without altering compromising the axenic nature of the culture. A sampling port can be configured with a valve or other device that allows the flow of sample to be stopped and started or to provide a means of continuous sampling. Bioreactors typically have at least one port that allows inoculation of a culture, and such a port can also be used for other purposes such as media or gas entry.

Bioreactors ports allow the gas content of the culture of microalgae to be manipulated. To illustrate, part of the volume of a bioreactor can be gas rather than liquid, and the gas inlets of the bioreactor to allow pumping of gases into the bioreactor. Gases that can be beneficially pumped into a bioreactor include air, oxygen, air/$CO_2$ mixtures, noble gases, such as argon, and other gases. Bioreactors are can be equipped to enable the user to control the rate of entry of a gas into the bioreactor. As noted above, increasing gas flow into a bioreactor can be used to increase mixing of the culture.

Increased gas flow affects the turbidity of the culture as well. Turbulence can be achieved by placing a gas entry port below the level of the aqueous culture media so that gas entering the bioreactor bubbles to the surface of the culture. One or more gas exit ports allow gas to escape, thereby preventing pressure buildup in the bioreactor. Preferably a gas exit port leads to a "one-way" valve that prevents contaminating microorganisms from entering the bioreactor.

3. Media

Microbial culture media typically contains components such as a fixed nitrogen source, a fixed carbon source, trace elements, optionally a buffer for pH maintenance, and phosphate (typically provided as a phosphate salt). Other components can include salts such as sodium chloride, particularly for seawater microalgae. Nitrogen sources include organic and inorganic nitrogen sources, including, for example, without limitation, molecular nitrogen, nitrate, nitrate salts, ammonia (pure or in salt form, such as, $(NH_4)_2SO_4$ and $NH_4OH$), protein, soybean meal, cornsteep liquor, and yeast extract. Examples of trace elements include zinc, boron, cobalt, copper, manganese, and molybdenum in, for example, the respective forms of $ZnCl_2$, $H_3BO_3$, $CoCl_2.6H_2O$, $CuCl_2.2H_2O$, $MnCl_2.4H_2O$ and $(NH_4)_6Mo_7O_{24}.4H_2O$.

Microorganisms useful in accordance with the methods of the present invention are found in various locations and environments throughout the world. As a consequence of their isolation from other species and their resulting evolutionary divergence, the particular growth medium for optimal growth and generation of lipid and/or hydrocarbon constituents can be difficult to predict. In some cases, certain strains of microorganisms may be unable to grow on a particular growth medium because of the presence of some inhibitory component or the absence of some essential nutritional requirement required by the particular strain of microorganism.

Solid and liquid growth media are generally available from a wide variety of sources, and instructions for the preparation of particular media that is suitable for a wide variety of strains of microorganisms can be found, for example, online at a site (www.utex.org) maintained by the University of Texas at Austin, 1 University Station A6700, Austin, Tex., 78712-0183, for its culture collection of algae (UTEX). For example, various fresh water and salt water media include those described in PCT Pub. No. 2008/151149, incorporated herein by reference.

In a particular example, Proteose Medium is suitable for axenic cultures, and a 1 L volume of the medium (pH ~6.8) can be prepared by addition of 1 g of proteose peptone to 1 liter of Bristol Medium. Bristol medium comprises 2.94 mM $NaNO_3$, 0.17 mM $CaCl_2.2H_2O$, 0.3 mM $MgSO_4.7H_2O$, 0.43 mM, 1.29 mM $KH_2PO_4$, and 1.43 mM NaCl in an aqueous solution. For 1.5% agar medium, 15 g of agar can be added to 1 L of the solution. The solution is covered and autoclaved, and then stored at a refrigerated temperature prior to use. Another example is the *Prototheca* isolation medium (PIM), which comprises 10 g/L potassium hydrogen phthalate (KHP), 0.9 g/L sodium hydroxide, 0.1 g/L magnesium sulfate, 0.2 g/L potassium hydrogen phosphate, 0.3 g/L ammonium chloride, 10 g/L glucose 0.001 g/L thiamine hydrochloride, 20 g/L agar, 0.25 g/L 5-fluorocytosine, at a pH in the range of 5.0 to 5.2 (see Pore, 1973, App. Microbiology, 26: 648-649). Other suitable media for use with the methods of the invention can be readily identified by consulting the URL identified above, or by consulting other organizations that maintain cultures of microorganisms, such as SAG, CCAP, or CCALA. SAG refers to the Culture Collection of Algae at the University of Göttingen (Göttingen, Germany), CCAP refers to the culture collection of algae and protozoa managed by the Scottish Association for Marine Science (Scotland, United Kingdom), and CCALA refers to the culture collection of algal laboratory at the Institute of Botany (Třeboň, Czech Republic). Additionally, U.S. Pat. No. 5,900,370 describes media formulations and conditions suitable for heterotrophic fermentation of *Prototheca* species.

For oil production, selection of a fixed carbon source is important, as the cost of the fixed carbon source must be sufficiently low to make oil production economical. Thus, while suitable carbon sources can include, for example, acetate, floridoside, fructose, galactose, glucuronic acid, glucose, glycerol, lactose, mannose, N-acetylglucosamine, rhamnose, sucrose, and/or xylose, selection of feedstocks containing those compounds is an important aspect of the methods of embodiments of the invention. Suitable feedstocks useful in accordance with the methods of the invention can include, for example, black liquor, corn starch, depolymerized cellulosic material, milk whey, molasses, potato, sorghum, sucrose, sugar beet, sugar cane, rice, and wheat. Carbon sources can also be provided as a mixture, such as a mixture of sucrose and depolymerized sugar beet pulp. The one or more carbon source(s) can be supplied at a concentration of at least about 50 µM, at least about 100 µM, at least about 500 µM, at least about 5 mM, at least about 50 mM, and at least about 500 mM, of one or more exogenously provided fixed carbon source(s). Highly concentrated carbon sources as feedstock for fermentation are preferred. For example, in some embodiments glucose levels of at least 300 g/L, at least 400 g/L, at least 500 g/L, or at least 600 g/L or more of glucose level of the feedstock prior to the cultivation step, is added to a fed batch cultivation, in which the highly concentrated fixed carbon source is fed to the cells over time as the cells grow and accumulate lipid. In other embodiments, sucrose levels of at least 500 g/L, at least 600 g/L, at least 700 g/L, at least 800 g/L or more of sucrose prior to the cultivation is added to a fed batch cultivation, in which the highly concentrated fixed carbon source is fed to the cells over time as the cells grow and accumulate lipid. Non-limiting examples of highly concentrated fixed carbon source such as sucrose include thick cane juice, sugar cane juice, sugar beet juice and molasses. Carbon sources of particular interest for purposes of the present invention include cellulose (in a depolymerized form), glycerol, sucrose, and sorghum, each of which is discussed in more detail below.

In accordance with the present invention, microorganisms can be cultured using depolymerized cellulosic biomass as a feedstock. Cellulosic biomass (e.g., stover, such as corn stover) is inexpensive and readily available; however, such feedstocks have been found to be inhibitory to yeast growth, and yeast cannot use the 5-carbon sugars produced from cellulosic materials (e.g., xylose from hemi-cellulose). By contrast, at least some microalgae can grow on processed cellulosic material. Cellulosic materials generally include about 40-60% cellulose; about 20-40% hemicellulose; and 10-30% lignin.

Cellulosic materials include residues from herbaceous and woody energy crops, as well as agricultural crops, i.e., the plant parts, primarily stalks and leaves, not removed from the fields with the primary food or fiber product. Examples include agricultural wastes such as sugarcane bagasse, rice hulls, corn fiber (including stalks, leaves, husks, and cobs), wheat straw, rice straw, sugar beet pulp, citrus pulp, citrus peels; forestry wastes such as hardwood and softwood thinnings, and hardwood and softwood residues from timber operations; wood wastes such as saw mill wastes (wood chips, sawdust) and pulp mill waste; urban wastes such as paper fractions of municipal solid waste, urban wood waste and urban green waste such as municipal grass clippings; and wood construction waste. Additional cellulosics include dedicated cellulosic crops such as switchgrass, hybrid poplar wood, and miscanthus, fiber cane, and fiber sorghum. Five-carbon sugars that are produced from such materials include xylose.

Cellulosic materials can be treated to increase the efficiency with which the microbe can utilize the sugar(s) contained within the materials. Embodiments of the invention provide methods for the treatment of cellulosic materials after acid explosion so that the materials are suitable for use in a heterotrophic culture of microbes (e.g., microalgae and oleaginous yeast). As discussed above, lignocellulosic biomass is comprised of various fractions, including cellulose, a crystalline polymer of beta 1,4 linked glucose (a six-carbon sugar), hemicellulose, a more loosely associated polymer predominantly comprised of xylose (a five-carbon sugar) and to a lesser extent mannose, galactose, arabinose, lignin, a complex aromatic polymer comprised of sinapyl alcohol and its derivatives, and pectins, which are linear chains of an alpha 1,4 linked polygalacturonic acid. Because of the polymeric structure of cellulose and hemicellulose, the sugars (e.g., monomeric glucose and xylose) in them are not in a form that can be efficiently used (metabolized) by many microbes. For such microbes, further processing of the cellulosic biomass to generate the monomeric sugars that make up the polymers can be very helpful to ensuring that the cellulosic materials are efficiently utilized as a feedstock (carbon source).

Celluose or cellulosic biomass is subjected to a process, termed "explosion", in which the biomass is treated with dilute sulfuric (or other) acid at elevated temperature and pressure. This process conditions the biomass such that it can be efficiently subjected to enzymatic hydrolysis of the cellulosic and hemicellulosic fractions into glucose and xylose monomers. The resulting monomeric sugars are termed cellulosic sugars. Cellulosic sugars can subsequently be utilized by microorganisms to produce a variety of metabolites (e.g., lipid). The acid explosion step results in a partial hydrolysis of the hemicellulose fraction to constitutent monosaccharides. These sugars can be completely liberated from the biomass with further treatment. In some embodiments, the further treatment is a hydrothermal treatment that includes washing the exploded material with hot water, which removes contaminants such as salts. This step is not necessary for cellulosic ethanol fermentations due to the more dilute sugar concentrations used in such processes. In other embodiments, the further treatment is additional acid treatment. In still other embodiments, the further treatment is enzymatic hydrolysis of the exploded material. These treatments can also be used in any combination. The type of treatment can affect the type of sugars liberated (e.g., five carbon sugars versus six carbon sugars) and the stage at which they are liberated in the process. As a consequence, different streams of sugars, whether they are predominantly five-carbon or six-carbon, can be created. These enriched five-carbon or six-carbon streams can thus be directed to specific microorganisms with different carbon utilization cabilities.

The methods of the present invention can involve fermentation to higher cell densities than what is typically achieved in ethanol fermentation. Because of the higher densities of the cultures for heterotrophic cellulosic oil production, the fixed carbon source (e.g., the cellulosic derived sugar stream(s)) is preferably in a concentrated form. The glucose level of the depolymerized cellulosic material is preferably at least 300 g/liter, at least 400 g/liter, at least 500 g/liter or at least 600 g/liter prior to the cultivation step, which is optionally a fed batch cultivation in which the material is fed to the cells over time as the cells grow and accumulate lipid. Thus, in order to generate and sustain the very high cell densities during the production of lignocellulosic oil, the carbon feedstock(s) can be delivered into the heterotrophic cultures in a highly concentrated form. However, any component in the feedstream that is not a substrate for, and is not metabolized by, the oleaginous microorganism will accumulate in the bioreactor, which can lead to problems if the component is toxic or inhibitory to production of the desired end product. While ligin and lignin-derived by-products, carbohydrate-derived byproducts such as furfurals and hydroxymethyl furfurals and salts derived from the generation of the cellulosic materials (both in the explosion process and the subsequent neutralization process), and even non-metabolized pentose/hexose sugars can present problems in ethanolic fermentations, these effects are amplified significantly in a process in which their concentration in the initial feedstock is high. To achieve sugar concentrations in the 300 g/L range (or higher) for six-carbon sugars that may be used in large scale production of lignocellulosic oil described in the present invention, the concentration of these toxic materials can be 20 times higher than the concentrations typically present in ethanolic fermentations of cellulosic biomass.

The explosion process treatment of the cellulosic material utilizes significant amounts of sulfuric acid, heat and pressure, thereby liberating by-products of carbohydrates, namely furfurals and hydroxymethyl furfurals. Furfurals and hydroxymethyl furfurals are produced during hydrolysis of hemicellulose through dehydration of xylose into furfural and water. In some embodiments of the present invention, these by-products (e.g., furfurals and hydroxymethyl furfurals) are removed from the saccharified lignocellulosic material prior to introduction into the bioreactor. In certain embodiments of the present invention, the process for removal of the by-products of carbohydrates is hydrothermal treatment of the exploded cellulosic materials. In addition, the present invention provides methods in which strains capable of tolerating compounds such as furfurals or hydroxymethyl furfurals are used for lignocellulosic oil production. In another embodiment, the present invention also provides methods and microorganisms that are not only capable of tolerating furfurals in the fermentation media, but are actually able to metabolize these by-products during the production of lignocellulosic oil.

The explosion process also generates significant levels of salts. For example, typical conditions for explosion can result in conductivites in excess of 5 mS/cm when the exploded cellulosic biomass is resuspended at a ratio of 10:1 water: solids (dry weight). In certain embodiments of the present invention, the diluted exploded biomass is subjected to enzymatic saccharification, and the resulting supernatant is concentrated up to 25 fold for use in the bioreactor. The salt level (as measured by conductivity) in the concentrated sugar stream(s) can be unacceptably high (up to 1.5 M $Na^+$ equivalents). Additional salts are generated upon neutralization of the exploded materials for the subsequent enzymatic saccharification process as well. Embodiments of the present invention provides methods for removing these salts so that the resulting concentrated cellulosic sugar stream(s) can be used in heterotrophic processes for producing lignocellulosic oil. In some embodiments, the method of removing these salts is deionization with resins, such as, but not limited to, DOWEX Marathon MR3. In certain embodiments, the deionization with resin step occurs before sugar concentration or pH adjustment and hydrothermal treatment of biomass prior to saccharification, or any combination of the preceding; in other embodiments, the step is conducted after one or more of these processes. In other embodiments, the explosion process itself is changed so as to avoid the generation of salts at unacceptably high levels. For example, an alternative to sulfuric acid (or other acid) explosion of the cellulosic biomass is mechanical pulping to render the cellulosic biomass receptive to enzymatic hydrolysis (saccharification). In still other embodiments, native strains of microorganisms resistant to high levels of salts or genetically engineered strains with resistance to high levels of salts are used.

A preferred embodiment for the process of preparing of exploded cellulosic biomass for use in heterotrophic lignocellulosic oil production using oleaginous microbes follows. A first step comprises adjusting the pH of the resuspended exploded cellulosic biomass to the range of 5.0-5.3 followed by washing the cellulosic biomass three times. This washing step can be accomplished by a variety of means including the use of desalting and ion exchange resins, reverse omosis, hydrothermal treatment (as described above), or just repeated re-suspension and centrifugation in deionized water. This wash step results in a cellulosic stream whose conductivity is between 100-300 µS/cm and the removal of significant amounts of furfurals and hydroxymethyl furfurals. Decants from this wash step can be saved to concentrate five-carbon sugars liberated from the hemicellulose fraction. A second step comprises enzymatic saccharification of the washed cellulosic biomass. In a preferred embodiment, Accellerase (Genencor) is used. A third step comprises the recovery of sugars via centrifugation or decanting and rinsing of the saccharified biomass. The resulting biomass (solids) is an energy dense, lignin rich component that can be used as fuel or sent to waste. The recovered sugar stream in the centrifugation/decanting and rinse process is collected. A fourth step comprises microfiltration to remove contaminating solids with recovery of the permeate. A fifth step comprises a concentration step which can be accomplished using a vacuum evaporator. This step can optionally include the addition of antifoam agents such as P'2000 (Sigma/Fluka), which is sometimes necessary due to the protein content of the resulting sugar feedstock.

In another embodiment of the methods of the invention, the carbon source is glycerol, including acidulated and non-acidulated glycerol byproduct from biodiesel transesterification. In one embodiment, the carbon source includes glycerol and at least one other carbon source. In some cases, all of the glycerol and the at least one other fixed carbon source are provided to the microorganism at the beginning of the fermentation. In some cases, the glycerol and the at least one other fixed carbon source are provided to the microorganism simultaneously at a predetermined ratio. In some cases, the glycerol and the at least one other fixed carbon source are fed to the microbes at a predetermined rate over the course of fermentation.

Some microalgae undergo cell division faster in the presence of glycerol than in the presence of glucose (see PCT Pub. No. 2008/151149). In these instances, two-stage growth processes, in which cells are first fed glycerol to rapidly increase cell density and are then fed glucose to accumulate lipids, can improve the efficiency with which lipids are produced. The use of the glycerol byproduct of the transesterification process can provide significant economic advantages when put back into the production process. Other feeding methods are provided as well, such as mixtures of glycerol and glucose. Feeding such mixtures also captures the same economic benefits. In addition, the invention provides methods of feeding alternative sugars to microalgae such as sucrose in various combinations with glycerol.

In another embodiment of the methods of the invention, the carbon source is invert sugar. Invert sugar is less prone to crystallization compared to sucrose and thus, can provide advantages for storage and in fed batch fermentation, which in the case of heterotrophic cultivation of microbes, including microalgae, there is a need for concentrated carbon source. In one embodiment, the carbon source is invert sugar, preferably in a concentrated form, preferably at least 800 g/liter, at least 900 g/liter, at least 1000 g/liter or at least 1100 g/liter prior to the cultivation step, which is optionally a fed batch cultivation. The invert sugar, preferably in a concentrated form, is fed to the cells over time as the cells grow and accumulate lipid.

In another embodiment of the methods of the invention, the carbon source is sucrose, including a complex feedstock containing sucrose, such as thick cane juice from sugar cane processing. Because of the higher densities of the cultures for heterotrophic oil production, the fixed carbon source (e.g., sucrose, glucose, etc.) is preferably in a concentrated form, preferably at least 500 g/liter, at least 600 g/liter, at least 700 g/liter or at least 800 g/liter of the fixed carbon source prior to the cultivation step, which is optionally a fed batch cultivation in which the material is fed to the cells over time as the cells grow and accumulate lipid. In some cases, the carbon source is sucrose in the form of thick cane juice, preferably in a concentrated form, preferably at least 60% solids or about 770 g/liter sugar, at least 70% solids or about 925 g/liter sugar, or at least 80% solids or about 1125 g/liter sugar prior to the cultivation step, which is optionally a fed batch cultivation. The concentrated thick cane juice is fed to the cells over time as the cells grow and accumulate lipid.

In one embodiment, the culture medium further includes at least one sucrose utilization enzyme. In some cases, the sucrose utilization enzyme is a sucrose invertase. The sucrose invertase enzyme can be a secrectable sucrose invertase enzyme encoded by an exogenous sucrose invertase gene expressed by the population of microorganisms. The secretable sucrose invertase can be secreted by the microorganisms into the culture medium so as to convert sucrose in the medium to glucose and fructose for use by the microorganism. As described below, the sucrose invertase can be recombinant, thereby imparting upon a microorganism the ability to use pure or complex sucrose feedstocks as a fixed carbon source for growth or oil production. In some cases, as described in more detail in Section IV, below, the microalgae has been genetically engineered to express a sucrose utilization enzyme, such as a sucrose transporter, a sucrose invertase, a hexokinase, a glucokinase, or a fructokinase.

Complex feedstocks containing sucrose include waste molasses from sugar cane processing; the use of this low-value waste product of sugar cane processing can provide significant cost savings in the production of hydrocarbons and other oils. Another complex feedstock containing sucrose that is useful in the methods of the invention is sorghum, including sorghum syrup and pure sorghum. *Sorghum* syrup is produced from the juice of sweet sorghum cane. Its sugar profile consists of mainly glucose (dextrose), fructose and sucrose.

4. Oil Production

For the production of oil in accordance with the methods of the invention, it is preferable to culture cells in the dark, as is the case, for example, when using extremely large (40,000 liter and higher) fermentors that do not allow light to strike the culture. Heterotrophic species are grown and propagated for the production of oil in a medium containing a fixed carbon source and in the absence of light; such growth is known as heterotrophic growth.

As an example, an inoculum of lipid-producing microalgal cells are introduced into the medium; there is a lag period (lag phase) before the cells begin to propagate. Following the lag period, the propagation rate increases steadily and enters the log, or exponential, phase. The exponential phase is in turn followed by a slowing of propagation due to decreases in nutrients such as nitrogen, increases in toxic substances, and quorum sensing mechanisms. After this slowing, propagation stops, and the cells enter a stationary phase or steady growth state, depending on the particular environment provided to the cells. For obtaining lipid rich biomass, the culture is typically harvested well after then end of the exponential phase, which may be terminated early by allowing nitrogen or another key nutrient (other than carbon) to become depleted, forcing the cells to convert the carbon sources, present in excess, to lipid, an in particular, to triglcyeride. Culture condition parameters can be manipulated to optimize total oil production, the combination of lipid species produced, and/or production of a specific oil.

Lipid production by cells disclosed herein can occur during the log phase or thereafter, including the stationary phase wherein nutrients are supplied, or still available, to allow the continuation of lipid production in the absence of cell division.

Preferably, microorganisms grown using conditions described herein and/or known in the art comprise at least about 20-30%, 30-40%, 40-50%, 50-60%, 60-70%, or 80-90% by dry cell weight of triglyceride. Process conditions can be adjusted to increase the yield of lipids suitable for a particular use and/or to reduce production cost. For example, in certain embodiments, a microalgae is cultured in the presence of a limiting concentration of one or more nutrients, such as, for example, nitrogen, phosphorous, or sulfur, while providing an excess of fixed carbon energy such as glucose. Nitrogen limitation tends to increase microbial lipid yield (a measure of the amount of lipid produced per gram of dry cell weight) over microbial lipid yield in a culture in which nitrogen is provided in excess. In particular embodiments, the increase in lipid yield is at least about: 10%, 50%, 100%, 200%, or 500%. The microbe can be cultured in the presence of a limiting amount of a nutrient for a portion of the total culture period or for the entire period. In particular embodiments, the nutrient concentration is cycled between a limiting concentration and a non-limiting concentration at least twice during the total culture period. Lipid content of cells can be increased by continuing the culture for increased periods of time while providing an excess of carbon, but limiting or no nitrogen.

In another embodiment, lipid yield is increased by culturing a lipid-producing microbe (e.g., microalgae) in the presence of one or more cofactor(s) for a lipid pathway enzyme (e.g., a coenzyme or prosthetic group of a fatty acid synthetic enzyme). Generally, the concentration of the cofactor(s) is sufficient to increase microbial lipid (e.g., fatty acid) yield over microbial lipid yield in the absence of the cofactor(s). In a particular embodiment, the cofactor(s) are provided to the culture by including in the culture a microbe (e.g., microalgae) containing an exogenous gene encoding the cofactor(s). Alternatively, cofactor(s) may be provided to a culture by including a microbe (e.g., microalgae) containing an exogenous gene that encodes a protein that participates in the synthesis of the cofactor. In certain embodiments, suitable cofactors include any vitamin required by a lipid pathway enzyme, such as, for example: biotin or pantothenate. Genes encoding cofactors suitable for use in the invention or that participate in the synthesis of such cofactors are well known and can be introduced into microbes (e.g., microalgae), using constructs and techniques such as those described above.

The specific examples of bioreactors, culture conditions, and heterotrophic growth and propagation methods described herein can be combined in any suitable manner to improve efficiencies of microbial growth and lipid and/or protein production.

Microalgal biomass with a high percentage of oil/lipid accumulation by dry weight has been generated using different methods of culture, which are known in the art (see PCT Pub. No. 2008/151149). Microalgal biomass generated by the culture methods described herein and useful in accordance with the present invention comprises at least 10% microalgal oil by dry weight. In some embodiments, the microalgal biomass comprises at least 25%, 50%, 60%, 70% or at least 80% microalgal oil by dry weight. In some embodiments, the microalgal biomass contains from 10-90% microalgal oil, from 25-75% microalgal oil, from 40-75% microalgal oil, 75-85%, or from 50-70% microalgal oil by dry weight.

The microalgal oil of the biomass described herein, or extracted from the biomass for use in the methods and compositions of the present invention can comprise glycerolipids with one or more distinct fatty acid ester side chains. Glycerolipids are comprised of a glycerol molecule esterified to one, two or three fatty acid molecules, which can be of varying lengths and have varying degrees of saturation. The length and saturation characteristics of the fatty acid molecules (and the microalgal oils) can be manipulated to modify the properties or proportions of the fatty acid molecules in microalgal oils of embodiments of the present invention via culture conditions or via lipid pathway engineering, as described in more detail in Section IV, below. Particular modifications of properties and proportions include alteration of the fatty acid distribution of the microbial triglycerides such as changes in chain length profile, saturation profile, and hydroxylation of fatty acids. The oils so produced can comprise a natural oil. Alternately, specific blends of microbial oil can be prepared either within a single species of algae by mixing together the biomass or algal oil from two or more species of microalgae, or by blending algal oil of the invention with oils from other sources such as soy, rapeseed, canola, palm, palm kernel, coconut, corn, waste vegetable, Chinese tallow, olive, sunflower, cottonseed, chicken fat, beef tallow, porcine tallow, microalgae, macroalgae, microbes, *Cuphea*, flax, peanut, choice white grease, lard, *Camelina sativa*, mustard seed, cashew nut, oats, lupine, kenaf, calendula, help, coffee, linseed (flax), hazelnut, euphorbia, pumpkin seed, coriander, camellia, sesame, safflower, rice, tung tree, cocoa, copra, pium poppy, castor beans, pecan, jojoba, macadamia, Brazil nuts, avocado, petroleum, or a distillate fraction of any of the preceding oils.

The oil composition, i.e., the properties and proportions of the fatty acid constituents of the glycerolipids, can also be manipulated by combining biomass or oil from at least two distinct species of microorganism. In some embodiments, at least two of the distinct species of microalgae have different glycerolipid profiles. The distinct species of microalgae can be cultured together or separately as described herein, preferably under heterotrophic conditions, to generate the respective oils. Different species of microalgae can contain different percentages of distinct fatty acid constituents in the cell's glycerolipids.

Generally, *Prototheca* strains have very little or no fatty acids with the chain length C8-C14. For example, *Prototheca moriformis* (UTEX 1435), *Prototheca krugani* (UTEX 329), *Prototheca stagnora* (UTEX 1442) and *Prototheca zopfii* (UTEX 1438) contains no (or undetectable amounts) C8 fatty acids, between 0-0.01% C10 fatty acids, between 0.03-2.1% C12 fatty acids and between 1.0-1.7% C14 fatty acids.

In some cases, the microbial strains containing a transgene encoding a fatty acyl-ACP thioesterase that has activity towards fatty acyl-ACP substrate of chain lengths C8 or C8-10 has at least 1.5%, at least 3.0%, at least 10%, at least 12% or more fatty acids of chain length C8. In other instances, the microbial strains containing a transgene encoding a fatty acyl ACP thioesterase that has activity towards fatty acyl-ACP substrate of chain lengths C10 has at least at least 5.0%, at least 10.0%, at least 24%, at least 29% or more fatty acids of chain length C10. In other instances, the microbial strains containing a transgene encoding a fatty acyl-ACP thioesterase that has activity towards fatty acyl-ACP substrate of chain length C12 has at least 5%, at least 15%, at least 34%, at least 50% or more fatty acids of the chain length C12. In other cases, the microbial strains containing a transgene encoding a fatty acyl-ACP thioesterase that has activity towards fatty acyl-ACP substrate of chain length C14 has at least 2.0%, at least 7%, at least 10%, at least 15%, at least 30%, at least 43% or more fatty acids of the chain length C14. In other cases, the microbial strains containing a transgene encoding a fatty acyl-ACP thioesterase that has activity towards fatty acyl-ACP substrate of chain length C16 has at least 30%, at least 40%, at least 66% or more fatty acids of the chain length C16. In still other cases, the microbial strains containing a transgene encoding a fatty acyl-ACP thioesterase that has activity towards fatty acyl-ACP substrate of chain length C18 and specifically for C18:0, has at least 5%, at least 10%, at least 26%, at least 40% or more C18:0 fatty acid levels. In any of these examples the microbe can be a microalgae, such as *Prototheca*.

In non-limiting examples, a microbial strain containing a transgene encoding a fatty acyl-ACP thioesterase that has activity towards fatty acyl-ACP substrate of chain length C8 has between 1-20%, preferably between 1.8-13%, fatty acids of chain length C8. In other non-limiting examples, a microbial strain containing a transgene encoding a fatty acyl-ACP thioesterase that has activity towards fatty acyl-ACP substrate of chain length C10 has between 1-40%, preferably between 1.91-30%, fatty acids of chain length C10. In other non-limiting examples, microbial strains containing a transgene encoding a fatty acyl-ACP thioesterase that has activity towards fatty acyl-ACP substrate of chain length C12 has between 10-60%, preferably between 13.55-55%, fatty acids of the chain length C12. In other non-limiting examples, microbial strains containing a transgene encoding a fatty acyl-ACP thioesterase that has activity towards fatty acyl-ACP substrate of chain length C14 has between 1-50%, preferably between 2.59-43.27%, fatty acids of the chain length C14. In other non-limiting examples, microbial strains containing a transgene encoding a fatty acyl-ACP thioesterase that has broad specificity towards fatty acyl-ACP substrates of varying carbon chain length has up to 70% fatty acids of the chain length C16. In other cases, microbial strains containing a transgene encoding a fatty acyl-ACP thioesterase that has activity towards fatty acyl-ACP substrate of chain length C16 has up to 75%, preferably up to 67.42%, fatty acids of the chain length C16. In some cases, the microbial strains containing a transgene encoding a fatty acyl-ACP thioesterase that has activity towards fatty acyl-ACP substrate of chain lengths between C8 and C14 have between 1-790%, or between about 2-80%, (C8-C14) fatty acids. In some cases, the microbial strains containing a transgene encoding a fatty acyl-ACP thioesterase that has activity towards fatty acyl-ACP substrates of chain lengths between C12 and C14 have at least 50% or 60%, C12-C14 fatty acids. In some instances, keeping the transgenic microbial strains under constant and high selective pressure to retain exogenous genes is advantageous due to the increase in the desired fatty acid of a specific chain length. High levels of exogenous gene retention can also be achieved by inserting exogenous genes into the nuclear chromosomes of the cells using homologous recombination vectors and methods disclosed herein. Recombinant cells containing exogenous genes integrated into nuclear chromosomes are an object of the invention. In any of these examples the microbe can be a microalgae, such as *Prototheca*.

Optionally, the microbial oil can also include other constituents produced by the microalgae, or incorporated into the microalgal oil from the culture medium. These other constituents can be present in varying amount depending on the culture conditions used to culture the microalgae, the species of microalgae, the extraction method used to recover microalgal oil from the biomass and other factors that may affect microalgal oil composition. Non-limiting examples of such constituents include carotenoids, present from 0.025-0.3 mcg/g, preferably from 0.05 to 0.244 micrograms/gram, of oil; chlorophyll A present from 0.025-0.3 mcg/g, preferably from 0.045 to 0.268 micrograms/gram, of oil; total chlorophyll of less than 0.03 mcg/g, preferably less than 0.025 micrograms/gram, of oil; gamma tocopherol present from 35-175 mcg/g, preferably from 38.3-164 micrograms/gram, of oil; total tocopherols present from 50-300 mcg/g, preferably from 60.8 to 261.7 microgram/gram, of oil; less than 0.5%, preferably less than 0.25%, brassicasterol, campesterol, stigmasterol, or betasitosterol; total tocotrienols less than 300 micrograms/gram of oil; and total tocotrienols present from 225-350 mcg/g, preferably from 249.6 to 325.3 micrograms/gram, of oil.

The other constituents can include, without limitation, phospholipids, tocopherols, tocotrienols, carotenoids (e.g., alpha-carotene, beta-carotene, lycopene, etc.), xanthophylls (e.g., lutein, zeaxanthin, alpha-cryptoxanthin and beta-cryptoxanthin), and various organic or inorganic compounds. In some cases, the oil extracted from *Prototheca* species comprises between 0.001 to 0.05, preferably from 0.003 to 0.039, microgram lutein/gram of oil, less than 0.005, preferably less than 0.003, micrograms lycopene/gram of oil; and less than 0.005, preferably less than 0.003, microgram beta carotene/gram of oil.

III. GENETIC ENGINEERING METHODS AND MATERIALS

The present invention provides methods and materials for genetically modifying *Prototheca* cells and recombinant host cells useful in the methods of the present invention, including but not limited to recombinant *Prototheca moriformis*, *Prototheca zopfii*, *Prototheca krugani*, and *Prototheca stagnora* host cells. The description of these methods and materials is divided into subsections for the convenience of the reader. In subsection 1, transformation methods are described. In subsection 2, genetic engineering methods using homologous recombination are described. In subsection 3, expression vectors and components are described.

1. Engineering Methods—Transformation

Cells can be transformed by any suitable technique including, e.g., biolistics, electroporation (see Maruyama et al. (2004), Biotechnology Techniques 8:821-826), glass bead transformation and silicon carbide whisker transformation. Another method that can be used involves forming protoplasts and using $CaCl_2$ and polyethylene glycol (PEG) to introduce recombinant DNA into microalgal cells (see Kim et al. (2002), *Mar. Biotechnol.* 4:63-73, which reports the use of this method for the transformation of *Chorella ellipsoidea*). Co-transformation of microalgae can be used to introduce two distinct vector molecules into a cell simultaneously (see for example Protist 2004 December; 155(4):381-93).

Biolistic methods (see, for example, Sanford, Trends In Biotech. (1988) 6:299 302, U.S. Pat. No. 4,945,050; electroporation (Fromm et al., Proc. Nat'l. Acad. Sci. (USA) (1985) 82:5824 5828); use of a laser beam, microinjection or any other method capable of introducing DNA into a microalgae can also be used for transformation of a *Prototheca* cell.

2. Engineering Methods—Homologous Recombination

Homologous recombination is the ability of complementary DNA sequences to align and exchange regions of homology. Transgenic DNA ("donor") containing sequences homologous to the genomic sequences being targeted ("template") is introduced into the organism and then undergoes recombination into the genome at the site of the corresponding genomic homologous sequences.

The ability to carry out homologous recombination in a host organism has many practical implications for what can be carried out at the molecular genetic level and is useful in the generation of an oleaginous microbe that can produced tailored oils. By its very nature homologous recombination is a precise gene targeting event, hence, most transgenic lines generated with the same targeting sequence will be essentially identical in terms of phenotype, necessitating the screening of far fewer transformation events. Homologous recombination also targets gene insertion events into the host chromosome, potentially resulting in excellent genetic stability, even in the absence of genetic selection. Because different chromosomal loci will likely impact gene expression, even from heterologous promoters/UTRs, homologous recombination can be a method of querying loci in an unfamiliar genome environment and to assess the impact of these environments on gene expression.

A particularly useful genetic engineering approach using homologous recombination is to co-opt specific host regulatory elements such as promoters/UTRs to drive heterologous gene expression in a highly specific fashion. For example, ablation or knockout of desaturase genes/gene families with a heterologous gene encoding a selective marker might be expected to increase the overall percentage of saturated fatty acids produced in the host cell. Example 6 describes the homologous recombination targeting constructs and a working example of such desaturase gene ablations or knockouts generated in *Prototheca moriformis*. Another approach to decreasing expression of an endogenous gene is to use an RNA-induced downregulation or silencing of gene expression including, but not limited to an RNAi or antisense approach, as well as a dsRNA approach. Antisense, RNAi, dsRNA approaches are well known in the art and include the introduction of an expression construct that when expressed as mRNA would lead to the formation of hairpin RNA or an expression construct containing a portion of the target gene that would be transcribed in the antisense orientation. All three approaches would result in the decreased expression of the target gene. Example 6 also describes expression constructs and a working example of the down-regulation of an endogenous *Prototheca moriformis* delta 12 desaturase gene (FADc) by an RNAi and antisense approach.

Because homologous recombination is a precise gene targeting event, it can be used to precisely modify any nucleotide (s) within a gene or region of interest, so long as sufficient flanking regions have been identified. Therefore, homologous recombination can be used as a means to modify regulatory sequences impacting gene expression of RNA and/or proteins. It can also be used to modify protein coding regions in an effort to modify enzyme activities such as substrate specificity, affinities and Km, and thus affecting the desired change in metabolism of the host cell. Homologous recombination provides a powerful means to manipulate the host genome resulting in gene targeting, gene conversion, gene deletion, gene duplication, gene inversion and exchanging gene expression regulatory elements such as promoters, enhancers and 3'UTRs.

Homologous recombination can be achieve by using targeting constructs containing pieces of endogenous sequences to "target" the gene or region of interest within the endogenous host cell genome. Such targeting sequences can either be located 5' of the gene or region of interest, 3' of the gene/region of interest or even flank the gene/region of interest. Such targeting constructs can be transformed into the host cell either as a supercoiled plasmid DNA with additional vector backbone, a PCR product with no vector backbone, or as a linearized molecule. In some cases, it may be advantageous to first expose the homologous sequences within the transgenic DNA (donor DNA) with a restriction enzyme. This step can increase the recombination efficiency and decrease the occurrence of undesired events. Other methods of increasing recombination efficiency include using PCR to generate transforming transgenic DNA containing linear ends homologous to the genomic sequences being targeted.

For purposes of non-limiting illustration, regions of donor DNA sequences that are useful for homologous recombination include the KE858 region of DNA in *Prototheca moriformis*. KE858 is a 1.3 kb, genomic fragment that encompasses part of the coding region for a protein that shares homology with the transfer RNA (tRNA) family of proteins. Southern blots have shown that the KE858 sequence is present in a single copy in the *Prototheca moriformis* (UTEX 1435) genome. This region and Examples of using this region for homologous recombination targeting has been described in PCT Application No. PCT/US2009/066142. Another region of donor DNA that is useful is the genomic sequence denoted here as "6S" (donor sequences at SEQ ID NO: 82, SEQ ID NO: 84). Note that the 6S sequence is not the 6S rRNA sequence. The use of this sequence in homologous recombination in *Prototheca morifomis* are described below in the Examples.

3. Vectors and Vector Components

Vectors for transformation of microorganisms in accordance with the present invention can be prepared by known techniques familiar to those skilled in the art in view of the disclosure herein. A vector typically contains one or more genes, in which each gene codes for the expression of a desired product (the gene product) and is operably linked to one or more control sequences that regulate gene expression or target the gene product to a particular location in the recombinant cell. To aid the reader, this subsection is divided into subsections. Subsection A describes control sequences typically contained on vectors as well as novel control sequences provided by the present invention. Subsection B describes genes typically contained in vectors as well as novel codon optimization methods and genes prepared using them provided by the invention.

A. Control Sequences

Control sequences are nucleic acids that regulate the expression of a coding sequence or direct a gene product to a particular location in or outside a cell. Control sequences that regulate expression include, for example, promoters that regulate transcription of a coding sequence and terminators that terminate transcription of a coding sequence. Another control sequence is a 3' untranslated sequence located at the end of a coding sequence that encodes a polyadenylation signal. Control sequences that direct gene products to particular locations include those that encode signal peptides, which direct the protein to which they are attached to a particular location in or outside the cell.

Thus, an exemplary vector design for expression of an exogenous gene in a microalgae contains a coding sequence for a desired gene product (for example, a selectable marker, a lipid pathway modification enzyme, or a sucrose utilization enzyme) in operable linkage with a promoter active in microalgae. Alternatively, if the vector does not contain a promoter in operable linkage with the coding sequence of interest, the coding sequence can be transformed into the cells such that it becomes operably linked to an endogenous promoter at the point of vector integration. The promoterless method of transformation has been proven to work in microalgae (see for example Plant Journal 14:4, (1998), pp. 441-447).

Many promoters are active in microalgae, including promoters that are endogenous to the algae being transformed, as well as promoters that are not endogenous to the algae being transformed (i.e., promoters from other algae, promoters from higher plants, and promoters from certain plant viruses or algae viruses). Illustrative exogenous and/or endogenous promoters that are active in microalgae (as well as antibiotic resistance genes functional in microalgae) are described in PCT Pub. No. 2008/151149 and references cited therein).

The promoter used to express an exogenous gene can be the promoter naturally linked to that gene or can be a heterologous promoter. Some promoters are active in more than one species of microalgae. Other promoters are species-specific. Illustrative promoters include promoters such as β-tubulin from *Chlamydomonas reinhardtii*, used in the Examples below, and viral promoters, such as cauliflower mosaic virus (CMV) and chlorella virus, which have been shown to be active in multiple species of microalgae (see for example Plant Cell Rep. 2005 March; 23(10-11):727-35; J Microbiol. 2005 August; 43(4):361-5; Mar Biotechnol (NY). 2002 January; 4(1):63-73). Another promoter that is suitable for use for expression of exogenous genes in *Prototheca* is the *Chlorella sorokiniana* glutamate dehydrogenase promoter/5'UTR. Optionally, at least 10, 20, 30, 40, 50, or 60 nucleotides or more of these sequences containing a promoter are used.

Illustrative promoters useful for expression of exogenous genes in *Prototheca* are listed in the sequence listing of this application, such as the promoter of the *Chlorella* HUP1 gene (SEQ ID NO:1) and the *Chlorella ellipsoidea* nitrate reductase promoter (SEQ ID NO:2). *Chlorella* virus promoters can also be used to express genes in *Prototheca*, such as SEQ ID NOs: 1-7 of U.S. Pat. No. 6,395,965. Additional promoters active in *Prototheca* can be found, for example, in Biochem Biophys Res Commun. 1994 Oct. 14; 204(1):187-94; Plant Mol Biol. 1994 October; 26(1):85-93; Virology. 2004 Aug. 15; 326(1):150-9; and Virology. 2004 Jan. 5; 318(1):214-23. Other useful promoters are described in detail in the Examples below.

A promoter can generally be characterized as either constitutive or inducible. Constitutive promoters are generally active or function to drive expression at all times (or at certain times in the cell life cycle) at the same level. Inducible promoters, conversely, are active (or rendered inactive) or are significantly up- or down-regulated only in response to a stimulus. Both types of promoters find application in the methods of the invention. Inducible promoters useful in the invention include those that mediate transcription of an operably linked gene in response to a stimulus, such as an exogenously provided small molecule (e.g., glucose, as in SEQ ID NO:1), temperature (heat or cold), lack of nitrogen in culture media, etc. Suitable promoters can activate transcription of an essentially silent gene or upregulate, preferably substantially, transcription of an operably linked gene that is transcribed at a low level. Examples below describe additional inducible promoters that are useful in *Prototheca* cells.

Inclusion of termination region control sequence is optional, and if employed, then the choice is be primarily one of convenience, as the termination region is relatively interchangeable. The termination region may be native to the transcriptional initiation region (the promoter), may be native to the DNA sequence of interest, or may be obtainable from another source. See, for example, Chen and Orozco, Nucleic Acids Res. (1988) 16:8411.

The present invention also provides control sequences and recombinant genes and vectors containing them that provide for the directing a gene product of interest to a particular cell compartment such as chloroplasts, plastids, mitochondria, or endoplasmic reticulum. In addition, embodiments of the present invention include control sequences and recombinant genes and vectors containing them that provide for the secretion of a protein outside the cell.

Proteins expressed in the nuclear genome of *Prototheca* can be targeted to the plastid using plastid targeting signals. Plastid targeting sequences endogenous to *Chlorella* are known, such as genes in the *Chlorella* nuclear genome that encode proteins that are targeted to the plastid; see for example GenBank Accession numbers AY646197 and AF499684, and in one embodiment, such control sequences are used in the vectors of the present invention to target expression of a protein to a *Prototheca* plastid.

The Examples below describe the use of algal plastid targeting sequences to target heterologous proteins to the correct compartment in the host cell. cDNA libraries were made using *Prototheca moriformis* and *Chlorella protothecodies* cells and are described in PCT Application No. PCT/US2009/066142.

In another embodiment of the present invention, the expression of a polypeptide in *Prototheca* is targeted to the endoplasmic reticulum. The inclusion of an appropriate retention or sorting signal in an expression vector ensure that proteins are retained in the endoplasmic reticulum (ER) and do not go downstream into Golgi. For example, the IMPACTVECTOR1.3 vector, from Wageningen UR—Plant Research International, includes the well known KDEL retention or sorting signal. With this vector, ER retention has a practical advantage in that it has been reported to improve expression levels 5-fold or more. The main reason for this appears to be that the ER contains lower concentrations and/or different proteases responsible for post-translational degradation of expressed proteins than are present in the cytoplasm. ER retention signals functional in green microalgae are known. For example, see Proc Natl Acad Sci USA. 2005 Apr. 26; 102(17):6225-30.

In another embodiment of the present invention, a polypeptide is targeted for secretion outside the cell into the culture media. See Hawkins et al., Current Microbiology Vol. 38 (1999), pp. 335-341 for examples of secretion signals active in *Chlorella* that can be used, in accordance with the methods of the invention, in *Prototheca*.

B. Genes and Codon Optimization

Typically, a gene includes a promoter, coding sequence, and termination control sequences. When assembled by recombinant DNA technology, a gene may be termed an expression cassette and may be flanked by restriction sites for convenient insertion into a vector that is used to introduce the recombinant gene into a host cell. The expression cassette can be flanked by DNA sequences from the genome or other nucleic acid target to facilitate stable integration of the expression cassette into the genome by homologous recombination. Alternatively, the vector and its expression cassette may remain unintegrated (e.g., an episome), in which case, the vector typically includes an origin of replication, which is capable of providing for replication of the heterologous vector DNA.

A common gene present on a vector is a gene that codes for a protein, the expression of which allows the recombinant cell containing the protein to be differentiated from cells that do not express the protein. Such a gene, and its corresponding gene product, is called a selectable marker or selection marker. Any of a wide variety of selectable markers can be employed in a transgene construct useful for transforming *Prototheca*. Examples of suitable selectable markers include the G418 resistance gene, the nitrate reductase gene (see Dawson et al. (1997), Current Microbiology 35:356-362), the hygromycin phosphotransferase gene (HPT; see Kim et al. (2002), Mar. Biotechnol. 4:63-73), the neomycin phosphotransferase gene, and the ble gene, which confers resistance to phleomycin (Huang et al. (2007), Appl. Microbiol. Biotechnol. 72:197-205). Methods of determining sensitivity of microalgae to antibiotics are well known. For example, Mol Gen Genet. 1996 Oct. 16; 252(5):572-9, sucrose invertase, as described herein, and thiamine auxotrophy complementation, as also described herein.

Other selectable markers that are not antibiotic-based can also be employed in a transgene construct useful for transforming microalgae in general, including *Prototheca* species. Genes that confers the ability to utilize certain carbon sources that were previously unable to be utilized by the microalgae can also be used as a selectable marker. By way of illustration, *Prototheca moriformis* strains typically grow poorly, if at all, on sucrose. Using a construct containing a sucrose invertase gene can confer the ability of positive transformants to grow on sucrose as a carbon substrate. Additional details on using sucrose utilization as a selectable marker along with other selectable markers are discussed in Section IV below.

For purposes of the present invention, the expression vector used to prepare a recombinant host cell of the invention will include at least two, and often three, genes, if one of the genes is a selectable marker. For example, a genetically engineered *Prototheca* of the invention can be made by transformation with vectors of the invention that comprise, in addition to a selectable marker, one or more exogenous genes, such as, for example, sucrose invertase gene or acyl ACP-thioesterase gene. One or both genes can be expressed using an inducible promoter, which allows the relative timing of expression of these genes to be controlled to enhance the lipid yield and conversion to fatty acid esters. Expression of the two or more exogenous genes may be under control of the same inducible promoter or under control of different inducible (or constitutive) promoters. In the latter situation, expression of a first exogenous gene can be induced for a first period of time (during which expression of a second exogenous gene may or may not be induced) and expression of a second exogenous gene can be induced for a second period of time (during which expression of a first exogenous gene may or may not be induced).

In other embodiments, the two or more exogenous genes (in addition to any selectable marker) are: a fatty acyl-ACP thioesterase and a fatty acyl-CoA/aldehyde reductase, the combined action of which yields an alcohol product. Further provided are other combinations of exogenous genes, including without limitation, a fatty acyl-ACP thioesterase and a fatty acyl-CoA reductase to generate aldehydes. In one embodiment, the vector provides for the combination of a fatty acyl-ACP thioesterase, a fatty acyl-CoA reductase, and a fatty aldehyde decarbonylase to generate alkanes. In each of these embodiments, one or more of the exogenous genes can be expressed using an inducible promoter.

Other illustrative vectors of the invention that express two or more exogenous genes include those encoding both a sucrose transporter and a sucrose invertase enzyme and those encoding both a selectable marker and a secreted sucrose invertase. The recombinant *Prototheca* transformed with either type of vector produce lipids at lower manufacturing cost due to the engineered ability to use sugar cane (and sugar cane-derived sugars) as a carbon source. Insertion of the two exogenous genes described above can be combined with the disruption of polysaccharide biosynthesis through directed and/or random mutagenesis, which steers ever greater carbon flux into lipid production. Individually and in combination, trophic conversion, engineering to alter lipid production and treatment with exogenous enzymes alter the lipid composition produced by a microorganism. The alteration can be a change in the amount of lipids produced, the amount of one or more hydrocarbon species produced relative to other lipids, and/or the types of lipid species produced in the microorganism. For example, microalgae can be engineered to produce a higher amount and/or percentage of TAGs (triacylglycerides).

For optimal expression of a recombinant protein, it is beneficial to employ coding sequences that produce mRNA with codons preferentially used by the host cell to be transformed. Thus, proper expression of transgenes can require that the codon usage of the transgene matches the specific codon bias of the organism in which the transgene is being expressed. The precise mechanisms underlying this effect are many, but include the proper balancing of available aminoacylated tRNA pools with proteins being synthesized in the cell, coupled with more efficient translation of the transgenic messenger RNA (mRNA) when this need is met. When codon usage in the transgene is not optimized, available tRNA pools are not sufficient to allow for efficient translation of the heterologous mRNA resulting in ribosomal stalling and termination and possible instability of the transgenic mRNA.

The present invention provides codon-optimized nucleic acids useful for the successful expression of recombinant proteins in *Prototheca*. Codon usage in *Prototheca* species was analyzed by studying cDNA sequences isolated from *Prototheca moriformis*. This analysis represents the interrogation over 24,000 codons and resulted in Table 2 below.

TABLE 2

Preferred codon usage in *Prototheca* strains.

| | | |
|---|---|---|
| Ala | GCG | 345 (0.36) |
| | GCA | 66 (0.07) |
| | GCT | 101 (0.11) |
| | GCC | 442 (0.46) |
| Cys | TGT | 12 (0.10) |
| | TGC | 105 (0.90) |
| Asp | GAT | 43 (0.12) |
| | GAC | 316 (0.88) |
| Glu | GAG | 377 (0.96) |
| | GAA | 14 (0.04) |
| Phe | TTT | 89 (0.29) |
| | TTC | 216 (0.71) |
| Gly | GGG | 92 (0.12) |
| | GGA | 56 (0.07) |
| | GGT | 76 (0.10) |
| | GGC | 559 (0.71) |
| His | CAT | 42 (0.21) |
| | CAC | 154 (0.79) |
| Ile | ATA | 4 (0.01) |
| | ATT | 30 (0.08) |
| | ATC | 338 (0.91) |
| Lys | AAG | 284 (0.98) |
| | AAA | 7 (0.02) |
| Leu | TTG | 26 (0.04) |
| | TTA | 3 (0.00) |
| | CTG | 447 (0.61) |
| | CTA | 20 (0.03) |
| | CTT | 45 (0.06) |
| | CTC | 190 (0.26) |
| Met | ATG | 191 (1.00) |
| Asn | AAT | 8 (0.04) |
| | AAC | 201 (0.96) |
| Pro | CCG | 161 (0.29) |
| | CCA | 49 (0.09) |
| | CCT | 71 (0.13) |
| | CCC | 267 (0.49) |
| Gln | CAG | 226 (0.82) |
| | CAA | 48 (0.18) |
| Arg | AGG | 33 (0.06) |
| | AGA | 14 (0.02) |
| | CGG | 102 (0.18) |
| | CGA | 49 (0.08) |
| | CGT | 51 (0.09) |
| | CGC | 331 (0.57) |
| Ser | AGT | 16 (0.03) |
| | AGC | 123 (0.22) |
| | TCG | 152 (0.28) |
| | TCA | 31 (0.06) |
| | TCT | 55 (0.10) |
| | TCC | 173 (0.31) |
| Thr | ACG | 184 (0.38) |
| | ACA | 24 (0.05) |
| | ACT | 21 (0.05) |
| | ACC | 249 (0.52) |
| Val | GTG | 308 (0.50) |
| | GTA | 9 (0.01) |
| | GTT | 35 (0.06) |
| | GTC | 262 (0.43) |
| Trp | TGG | 107 (1.00) |
| Tyr | TAT | 10 (0.05) |
| | TAC | 180 (0.95) |
| Stop | TGA/TAG/TAA | |

In other embodiments, the gene in the recombinant vector has been codon-optimized with reference to a microalgal strain other than a *Prototheca* strain. For example, methods of recoding genes for expression in microalgae are described in U.S. Pat. No. 7,135,290. Additional information for codon optimization is available, e.g., at the codon usage database of GenBank.

In connection with embodiments having codon optimized genes, the optimized genes are preferably optimized so as to increase expression of the gene product of the gene being optimized by at least 10% and more preferably by at least 20, 40, 60, 80, 100, or 200%.

While the methods and materials of the invention allow for the introduction of any exogenous gene into *Prototheca*, genes relating to sucrose utilization and lipid pathway modification are of particular interest, as discussed in the following sections.

IV. SELECTABLE MARKERS

1. Sucrose Utilization

In an embodiment, the recombinant cell of the invention further contains one or more exogenous sucrose utilization genes. In various embodiments, the one or more genes encode one or more proteins selected from the group consisting of a fructokinase, a glucokinase, a hexokinase, a sucrose invertase, a sucrose transporter. For example, expression of a sucrose transporter and a sucrose invertase allows *Prototheca* to transport sucrose into the cell from the culture media and hydrolyze sucrose to yield glucose and fructose. Optionally, a fructokinase can be expressed as well in instances where endogenous hexokinase activity is insufficient for maximum phosphorylation of fructose. Examples of suitable sucrose transporters are Genbank accession numbers CAD91334, CAB92307, and CAA53390. Examples of suitable fructokinases are Genbank accession numbers P26984, P26420 and CAA43322.

In one embodiment, the present invention provides a host cell that secretes a sucrose invertase. Secretion of a sucrose invertase obviates the need for expression of a transporter that can transport sucrose into the cell. This is because a secreted invertase catalyzes the conversion of a molecule of sucrose into a molecule of glucose and a molecule of fructose, both of which can be transported and utilized by microbes provided by the invention. For example, expression of a sucrose invertase (such as SEQ ID NO:3) with a secretion signal (such as that of SEQ ID NO: 4 (from yeast), SEQ ID NO: 5 (from higher plants), SEQ ID NO: 6 (eukaryotic consensus secretion signal), and SEQ ID NO: 7 (combination of signal sequence from higher plants and eukaryotic consensus) generates invertase activity outside the cell. Expression of such a protein, as enabled by the genetic engineering methodology disclosed herein, allows cells already capable of utilizing extracellular glucose as an energy source to utilize sucrose as an extracellular energy source.

*Prototheca* species expressing an invertase in media containing sucrose are a preferred microalgal species for the production of oil. The expression and extracellular targeting of this fully active protein allows the resulting host cells to grow on sucrose, whereas their non-transformed counterparts cannot. Thus, embodiments of the present invention provide recombinant microalgae (including *Prototheca*) cells with a codon-optimized invertase gene, including but not limited to the yeast invertase gene, integrated into their genome such that the invertase gene is expressed as assessed by invertase activity and sucrose hydrolysis. Invertase genes are useful as selectable markers in the recombinant cells, as such cells are able to grow on sucrose, while their non-transformed counterparts cannot; and methods for selecting recombinant host cells using an invertase as a powerful, selectable marker for algal molecular genetics.

The successful expression of a sucrose invertase in *Prototheca* also illustrates another aspect of the present invention in that it demonstrates that heterologous (recombinant) proteins can be expressed in the algal cell and successfully transit outside of the cell and into the culture medium in a fully active and functional form. Thus, embodiments of the present invention provide methods and reagents for expressing a wide and diverse array of heterologous proteins in microalgae and secreting them outside of the host cell. Such proteins include, for example, industrial enzymes such as, for example, lipases, proteases, cellulases, pectinases, amylases, esterases, oxidoreductases, transferases, lactases, isomerases, and invertases, as well as therapeutic proteins such as, for example, growth factors, cytokines, full length antibodies comprising two light and two heavy chains, Fabs, scFvs (single chain variable fragment), camellid-type antibodies, antibody fragments, antibody fragment-fusions, antibody-receptor fusions, insulin, interferons, and insulin-like growth factors.

The successful expression of a sucrose invertase in *Prototheca* also illustrates another aspect of the present invention in that it provides methods and reagents for the use of fungal transit peptides in algae to direct secretion of proteins in *Prototheca*; and methods and reagents for determining if a peptide can function, and the ability of it to function, as a transit peptide in *Prototheca* cells. The methods and reagents of the invention can be used as a tool and platform to identify other transit peptides that can successfully traffic proteins outside of a cell, and that the yeast invertase has great utility in these methods. As demonstrated in this example, removal of the endogenous yeast invertase transit peptide and its replacement by other transit peptides, either endogenous to the host algae or from other sources (eukaryotic, prokaryotic and viral), can identify whether any peptide of interest can function as a transit peptide in guiding protein egress from the cell.

Examples of suitable sucrose invertases include those identified by Genbank accession numbers CAB95010, NP_012104 and CAA06839. Non-limiting examples of suitable invertases are listed below in Table 3 Amino acid sequences for each listed invertase are included in the Sequence Listing below. In some cases, the exogenous sucrose utilization gene suitable for use in the methods and vectors of the invention encodes a sucrose invertase that has at least 40, 50, 60, 75, or 90% or higher amino acid identity with a sucrose invertase selected from Table 3.

TABLE 3

Sucrose invertases.

| Description | Organism | GenBank Accession No. | SEQ ID NO: |
|---|---|---|---|
| Invertase | *Chicorium intybus* | Y11124 | SEQ ID NO: 20 |
| Invertase | *Schizosaccharomyces pombe* | AB011433 | SEQ ID NO: 21 |
| beta-fructofuranosidase (invertase) | *Pichia anomala* | X80640 | SEQ ID NO: 22 |
| Invertase | *Debaryomyces occidentalis* | X17604 | SEQ ID NO: 23 |
| Invertase | *Oryza sativa* | AF019113 | SEQ ID NO: 24 |
| Invertase | *Allium cepa* | AJ006067 | SEQ ID NO: 25 |
| Invertase | *Beta vulgaris* subsp. *Vulgaris* | AJ278531 | SEQ ID NO: 26 |
| beta-fructofuranosidase (invertase) | *Bifidobacterium breve* UCC2003 | AAT28190 | SEQ ID NO: 27 |
| Invertase | *Saccharomyces cerevisiae* | NP_012104 | SEQ ID NO: 8 (nucleotide) SEQ ID NO: 28 (amino acid) |
| Invertase A | *Zymomonas mobilis* | AA038865 | SEQ ID NO: 29 |

The secretion of an invertase to the culture medium by *Prototheca* enable the cells to grow as well on waste molasses from sugar cane processing as they do on pure reagent-grade glucose; the use of this low-value waste product of sugar cane processing can provide significant cost savings in the production of lipids and other oils. Thus, the present invention provides a microbial culture containing a population of *Prototheca* microorganisms, and a culture medium comprising (i) sucrose and (ii) a sucrose invertase enzyme. In various embodiments the sucrose in the culture comes from sorghum, sugar beet, sugar cane, molasses, or depolymerized cellulosic material (which may optionally contain lignin). In another aspect, the methods and reagents of the invention significantly increase the number and type of feedstocks that can be utilized by recombinant microalgae or other microbes. While the microbes exemplified here are altered such that they can utilize sucrose, the methods and reagents of the invention can be applied so that feedstocks such as cellulosics are utilizable by an engineered host microbe of the invention with the ability to secrete cellulases, pectinases, isomerases, or the like, such that the breakdown products of the enzymatic reactions are no longer just simply tolerated but rather utilized as a carbon source by the host. An example of this is described below and in the Examples of microbes engineered to express a secretable α-galactosidase, conferring the ability to hydrolyze α-galactosyl bonds in oligosaccharides such as those contained in raffinose and stachyose which are two oligosaccharides found in agricultural waste streams.

2. Alpha-Galactosidase Expression

While the expression of a sucrose invertase, as described above, confers the ability for *Prototheca* cells to more efficiently utilize sucrose as a carbon source (via the enzyme hydrolyzing the α-linkage between fructose and glucose molecules in the disaccharide sucrose), the expression of other enzymes that hydrolyze other types of α-linkages in oligosaccharides can confer the ability for *Prototheca* cells to utilize other carbon sources. The expression of these enzymes (and the resulting ability to utilize carbon sources that *Prototheca* and other microalgal cells ordinarily would not be able to) can be used as a selectable marker for these transgenic *Prototheca* cells by allowing for the selection of positive clones that are able to grow on these carbon sources.

In an embodiment, the recombinant *Prototheca* cell of the invention further contains one or more exogenous genes encoding polysaccharide-degrading enzymes. In various embodiments, the one or more genes encoding a polysaccharide-degrading enzyme is a gene encoding a secreted α-galactosidase. The expression of an exogenous secreted α-galactosidase in a *Prototheca* cell confers the ability of such transformed strains to grow on sugars (carbon sources) containing D-galactosyl linkages, such as α-linkages between galactose and glucose monosaccharide units. *Prototheca* strains expressing an exogenous, secreted α-galactosidase will be able to utilize disaccharides such as melibiose (disaccharide composed of α-D-galactose-glucose).

Sugars such as raffinose (a trisaccharide comprised of α-linked galactose-glucose-fructose) and stachyose (a tetrasaccharide composed to two α-linked D-galactose units, followed by α-linked glucose and fructose) are present in significant proportions in agricultural waste streams such as beet pulp (raffinose) and soybean meal (stachyose). Such agricultural residues represent a significant untapped carbon source for the conversion into oil by microbes (including *Prototheca*) capable of utilizing them.

*Prototheca* strains are unable to utilize oligosaccharides such as raffinose and stachyose in any significant quantity or at all. In the case of raffinose and stachyose, although transgenic strains expressing a sucrose invertase (as described above) have the ability to hydrolyze the α-linkage between fructose and glucose in α-galactosyl derivatives of sucrose, but the remainder of the oligosaccharide remains unutilized, as sucrose invertase will not cleave the remaining α-linkages in such sugars and the resulting disaccharides are not utilizable. In another embodiment, the recombinant *Prototheca* cell of the invention comprises both an exogenous gene encoding a sucrose invertase and an exogenous gene encoding an α-galactosidase. Thus, strains expressing both a sucrose invertase and an α-galactosidase will be capable of fully hydrolyzing oligosaccharides such as raffinose and stachyose, enabling the consumption of the component monomers. In addition, α-galactosidase encoding genes may be used as a selectable marker for transformation. Clones containing the exogenous α-galactosidase gene will have the ability to grow on melibiose. Examples of suitable α-galactosidase genes for use in *Prototheca* strains include the MEL1 gene from *Saccharomyces carlbergensis*, the AglC gene from *Aspergilus niger*. Interestingly, not all α-galactosidase genes have been found to be functional in *Prototheca* species, even if the genes are optimized according to the preferred codon usage in *Prototheca* strains. The Examples below demonstrates the ability of transgenic *Prototheca* cells to grow on melibiose when transformed with codon-optimized MEL1 gene from *S. carlbergensis* and the AglC gene from *A. niger*, but not an α-galactosidase encoding gene from the higher plant, *Cyamopsis tetragonobola* (Guar bean).

3. Thiamine Auxotrophy Complementation

*Prototheca* strains including *Prototheca moriformis* are known to be thiamine auxotrophic (See, for example, Ciferri, O. (1956) *Nature*, v. 178, pp. 1475-1476), meaning that these strains require thiamine in the nutrient media for growth Thiamine auxotrophy can be the result of mutations or lack of expression of enzymes in the thiamine biosynthetic pathway. Complemented transgenic strains expressing the missing enzyme(s) in the thiamine biosynthetic pathway can then be grown without added thiamine, thus reducing the cost of the nutrient media as well as rendering the resulting microalgal biomass more desirable for use as an animal feed. Complementation with a thiamine biosynthetic pathway enzyme can also be used as a selectable marker as the transgenic gene confers the ability to grow on plates/media that does not contain thiamine.

In an embodiment, the recombinant *Prototheca* cell of the invention further contains one or more exogenous genes encoding thiamine biosynthetic pathway enzyme. In another embodiment, the recombinant *Prototheca* cell of the invention comprises an exogenous gene encoding hydroxymethylpyrimidine phosphate synthases from algal, plant or cyanobacterial sources. In still other embodiments, the hydroxymethylpyrimidine phosphate synthase is encoded by a THIC gene. In still other embodiments, the THIC gene the *Coccomyxa* C-169 THIC, *Arabidopsis thaliana* THIC, or the *Synechocystis* sp. PCC 6803 thiC. The Examples below details the engineering of *Prototheca moriformis* UTEX 1435 with restored thiamine prototrophy.

V. LIPID PATHWAY ENGINEERING

In addition to altering the ability of microalgae or other microbes to utilize feedstocks such as sucrose-containing feedstocks, the present invention also provides recombinant microalgae or other microbes that have been modified to alter the properties and/or proportions of lipids produced. The pathway can further, or alternatively, be modified to alter the properties and/or proportions of various lipid molecules produced through enzymatic processing of lipids and intermediates in the fatty acid pathway. In various embodiments, the recombinant Prototheca cells of the invention have, relative to their untransformed counterparts, optimized lipid yield per unit volume and/or per unit time, carbon chain length (e.g., for renewable diesel production or for industrial chemicals applications requiring lipid feedstock), reduced or increased number and/or position of double bonds, optionally to zero, hydroxylation of fatty acids, and increasing the hydrogen: carbon ratio of a particular species of lipid or of a population of distinct lipid.

In particular embodiments, one or more key enzymes that control branch points in metabolism to fatty acid synthesis have been up-regulated or down-regulated to improve lipid production. Up-regulation can be achieved, for example, by transforming cells with expression constructs in which a gene encoding the enzyme of interest is expressed, e.g., using a strong promoter and/or enhancer elements that increase transcription. Such constructs can include a selectable marker such that the transformants can be subjected to selection, which can result in gene maintainance, and possibly amplification of the construct and an increase in the expression level of the encoded enzyme. Examples of enzymes suitable for up-regulation according to the methods of the invention include pyruvate dehydrogenase, which plays a role in converting pyruvate to acetyl-CoA (examples, some from microalgae, include Genbank accession numbers NP_415392; AAA53047; Q1XDM1; and CAF05587). Up-regulation of pyruvate dehydrogenase can increase production of acetyl-CoA, and thereby increase fatty acid synthesis. Acetyl-CoA carboxylase catalyzes the initial step in fatty acid synthesis. Accordingly, this enzyme can be up-regulated to increase production of fatty acids (examples, some from microalgae, include Genbank accession numbers BAA94752; AAA75528; AAA81471; YP_537052; YP_536879; NP_045833; and BAA57908). Fatty acid production can also be increased by up-regulation of acyl carrier protein (ACP), which carries the growing acyl chains during fatty acid synthesis (examples, some from microalgae, include Genbank accession numbers A0T0F8; P51280; NP_849041; YP_874433). Glycerol-3-phosphate acyltransferase catalyzes the rate-limiting step of fatty acid synthesis. Up-regulation of this enzyme can increase fatty acid production (examples, some from microalgae, include Genbank accession numbers AAA74319; AAA33122; AAA37647; P44857; and ABO94442).

Up- and/or down-regulation of genes can be applied to global regulators controlling the expression of the genes of the fatty acid biosynthetic pathways. Accordingly, one or more global regulators of fatty acid synthesis can be up- or down-regulated, as appropriate, to inhibit or enhance, respectively, the expression of a plurality of fatty acid synthetic genes and, ultimately, to increase lipid production. Examples include sterol regulatory element binding proteins (SREBPs), such as SREBP-1a and SREBP-1c (for examples see Genbank accession numbers NP_035610 and Q9WTN3).

The present invention also provides recombinant Prototheca cells that have been modified to contain one or more exogenous genes encoding lipid modification enzymes such as, for example, fatty acyl-ACP thioesterases (see Table 4), fatty acyl-CoA/aldehyde reductases (see Table 6), fatty acyl-CoA reductases (see Table 7), fatty aldehyde decarbonylase (see Table 8), fatty aldehyde reductases, desaturases (such as stearoyl-ACP desaturases and fatty acyl desaturases and squalene synthases (see GenBank Accession number AF205791). Although fatty acyl-ACP thioesterases typically do not directly chemically modify the lipids, their manipulation in accordance with embodiments of the invention can alter the fatty acid profile of a cell, especially in terms of chain length and double bond distribution. In some embodiments, genes encoding a fatty acyl-ACP thioesterase and a naturally co-expressed acyl carrier protein are transformed into a Prototheca or other microalgal or microbial cell, optionally with one or more genes encoding other lipid modification enzymes. In other embodiments, the ACP and the fatty acyl-ACP thioesterase may have an affinity for one another that imparts an advantage when the two are used together in the microbes and methods of the present invention, irrespective of whether they are or are not naturally co-expressed in a particular tissue or organism. Thus, embodiments of the present invention contemplate both naturally co-expressed pairs of these enzymes as well as those that share an affinity for interacting with one another to facilitate cleavage of a length-specific carbon chain from the ACP.

In still other embodiments, an exogenous gene encoding a desaturase is transformed into the microalgal or other microbial cell in conjunction with one or more genes encoding other lipid modification enzymes to provide modifications with respect to lipid saturation. In other embodiments, an endogenous desaturase gene is overexpressed (e.g., through the introduction of additional copies off the gene) in a microalgal or other microbial cell. Stearoyl-ACP desaturase (see, e.g., GenBank Accession numbers AAF15308; ABM45911; and AAY86086), for example, catalyzes the conversion of stearoyl-ACP to oleoyl-ACP. Up-regulation of this gene can increase the proportion of monounsaturated fatty acids produced by a cell; whereas down-regulation can reduce the proportion of monounsaturates. For illustrative purposes, stearoyl-ACP desaturases (SAD) are responsible for the synthesis of C18:1 fatty acids from C18:0 precursors. Another family of desaturases are the fatty acyl desaturases (FAD), including delta 12 fatty acid desaturases (Δ12 FAD). These desaturases also provide modifications with respect to lipid saturation. For illustrative purposes, delta 12 fatty acid desaturases are responsible for the synthesis of C18:2 fatty acids from C18:1 precursors. Similarly, the expression of one or more glycerolipid desaturases can be controlled to alter the ratio of unsaturated to saturated fatty acids such as ω-6 fatty acid desaturase, ω-3 fatty acid desaturase, or ω-6-oleate desaturase. In some embodiments, the desaturase can be selected with reference to a desired carbon chain length, such that the desaturase is capable of making location specific modifications within a specified carbon-length substrate, or substrates having a carbon-length within a specified range. In another embodiment, if the desired fatty acid profile is an increase in monounsaturates (such as C16:1 and/or C18:1) overexpression of a SAD or expression of a heterologous SAD can be coupled with the silencing or inactivation (e.g., through mutation, RNAi, antisense, or knockout of an endogenous desaturase gene, etc.) of a fatty acyl desaturase (FAD) or another desaturase gene.

In other embodiments, the microalgal or other microbial cell has been modified to have a mutated endogenous desaturase gene, wherein the mutation renders the gene or desaturase enzyme inactive. In some cases, the mutated endogenous desaturase gene is a fatty acid desaturase (FAD). In other cases, the mutated endogenous desaturase gene is a stearoyl Acyl carrier protein desaturase (SAD). Example 6 below describes the targeted ablation or knockout of stearoyl-ACP desaturases and delta 12 fatty acid desaturases in Prototheca. Example 6 also describes the use of RNAi or antisense constructs to decrease the expression of an endogenous desaturase gene.

In some cases, it may be advantageous to pair one or more of the genetic engineering techniques in order to achieve a trangenic cell that produces the desired lipid profile. In one embodiment, a microalgal or other microbial cell comprises a mutated endogenous desaturase gene and one or more exogenous gene. In non-limiting examples, a microalgal or other microbial cell with a mutated endogenous desaturase gene can also express an exogenous fatty acyl-ACP thioesterase gene and/or a sucrose invertase gene. Example 6 below describes a transgenic *Prototheca* cell containing a targeted ablation or knockout of an endogenous SAD and also expresses a *Cinnamomum camphora* C14-preferring thioesterase and a sucrose invertase. In this case, the transgenic *Prototheca* cell produces a lipid profile that closely approximates the lipid profile found in tallow. Tallow is typically derived from rendered beef or mutton fat, is solid at room temperature and is utilized in a variety of applications in the food, cosmetics, and chemicals industries. The fatty acid profile of tallow is: 4% C14:0; 26% C16:0; 3% C16:1; 14% C18:0; 41% C18:1; 3% C18:2; and 1% C18:3. As is shown in Example 6 below, clones of transgenic *Prototheca* cells with a targeted ablation or knockout of an endogenous SAD and expressing a *C. camphora* C14-preferring thioesterase have lipid profiles of: less than 1% C12 and shorter carbon chain length fatty acids; 2.74% to 6.13% C14:0; 23.07% to 25.69% C16:0; 7.02% to 11.08% C18:0; 42.03% to 51.21% C18:1; and 9.37% to 13.45% C18:2 (expressed in area percent). In some cases, the transgenic *Prototheca* cells have lipid profiles of: 3-5% C14:0; 25-27% C16:0; 10-15% C18:0; and 40-45% C18:1.

In particular embodiments, microbes of the present invention are genetically engineered to express one or more exogenous genes selected from an acyl-ACP thioesterase, an acyl-CoA/aldehyde reductase, a fatty acyl-CoA reductase, a fatty aldehyde reductase, a fatty aldehyde decarbonylase, or a naturally co-expressed acyl carrier protein. Suitable expression methods are described above with respect to the expression of a lipase gene, including, among other methods, inducible expression and compartmentalized expression. A fatty acyl-ACP thioesterase cleaves a fatty acid from an acyl carrier protein (ACP) during lipid synthesis. Through further enzymatic processing, the cleaved fatty acid is then combined with a coenzyme to yield an acyl-CoA molecule. This acyl-CoA is the substrate for the enzymatic activity of a fatty acyl-CoA reductase to yield an aldehyde, as well as for a fatty acyl-CoA/aldehyde reductase to yield an alcohol. The aldehyde produced by the action of the fatty acyl-CoA reductase identified above is the substrate for further enzymatic activity by either a fatty aldehyde reductase to yield an alcohol, or a fatty aldehyde decarbonylase to yield an alkane or alkene.

In some embodiments, fatty acids, glycerolipids, or the corresponding primary alcohols, aldehydes, alkanes or alkenes, generated by the methods described herein, contain 8, 10, 12, or 14 carbon atoms. Preferred fatty acids for the production of diesel, biodiesel, renewable diesel, or jet fuel, or the corresponding primary alcohols, aldehydes, alkanes and alkenes, for industrial applications contain 8 to 14 carbon atoms. In certain embodiments, the above fatty acids, as well as the other corresponding hydrocarbon molecules, are saturated (with no carbon-carbon double or triple bonds); mono unsaturated (single double bond); poly unsaturated (two or more double bonds); are linear (not cyclic) or branched. For fuel production, greater saturation is preferred.

The enzymes described directly above have a preferential specificity for hydrolysis of a substrate containing a specific number of carbon atoms. For example, a fatty acyl-ACP thioesterase may have a preference for cleaving a fatty acid having 12 carbon atoms from the ACP. In some embodiments, the ACP and the length-specific thioesterase may have an affinity for one another that makes them particularly useful as a combination (e.g., the exogenous ACP and thioesterase genes may be naturally co-expressed in a particular tissue or organism from which they are derived). Therefore, in various embodiments, the recombinant *Prototheca* cell of the invention can contain an exogenous gene that encodes a protein with specificity for catalyzing an enzymatic activity (e.g., cleavage of a fatty acid from an ACP, reduction of an acyl-CoA to an aldehyde or an alcohol, or conversion of an aldehyde to an alkane) with regard to the number of carbon atoms contained in the substrate. The enzymatic specificity can, in various embodiments, be for a substrate having from 8 to 34 carbon atoms, preferably from 8 to 18 carbon atoms, and more preferably from 8 to 14 carbon atoms. A preferred specificity is for a substrate having fewer, i.e., 12, rather than more, i.e., 18, carbon atoms.

Other fatty acyl-ACP thioesterases suitable for use with the microbes and methods of the invention include, without limitation, those listed in Table 4.

TABLE 4

Fatty acyl-ACP thioesterases and GenBank accession numbers.

*Umbellularia californica* fatty acyl-ACP thioesterase (GenBank #AAC49001)
*Cinnamomum camphora* fatty acyl-ACP thioesterase (GenBank #Q39473)
*Umbellularia californica* fatty acyl-ACP thioesterase (GenBank #Q41635)
*Myristica fragrans* fatty acyl-ACP thioesterase (GenBank #AAB71729)
*Myristica fragrans* fatty acyl-ACP thioesterase (GenBank #AAB71730)
*Elaeis guineensis* fatty acyl-ACP thioesterase (GenBank #ABD83939)
*Elaeis guineensis* fatty acyl-ACP thioesterase (GenBank #AAD42220)
*Elaeis guineensis* fatty acyl-ACP thioesterase (GenBank #AAD42220.2)
*Populus tomentosa* fatty acyl-ACP thioesterase (GenBank #ABC47311)
*Arabidopsis thaliana* fatty acyl-ACP thioesterase (GenBank #NP_172327)
*Arabidopsis thaliana* fatty acyl-ACP thioesterase (GenBank #CAA85387)
*Arabidopsis thaliana* fatty acyl-ACP thioesterase (GenBank #CAA85388)
*Gossypium hirsutum* fatty acyl-ACP thioesterase (GenBank #Q9SQI3)
*Cuphea lanceolata* fatty acyl-ACP thioesterase (GenBank #CAA54060)
*Cuphea hookeriana* fatty acyl-ACP thioesterase (GenBank #AAC72882)
*Cuphea calophylla* subsp. *mesostemon* fatty acyl-ACP thioesterase (GenBank #ABB71581)
*Cuphea lanceolata* fatty acyl-ACP thioesterase (GenBank #CAC19933)
*Elaeis guineensis* fatty acyl-ACP thioesterase (GenBank #AAL15645)
*Cuphea hookeriana* fatty acyl-ACP thioesterase (GenBank #Q39513)
*Cuphea hookeriana* fatty acyl-ACP thioesterase (GenBank #Q39513.1)
*Gossypium hirsutum* fatty acyl-ACP thioesterase (GenBank #AAD01982)
*Vitis vinifera* fatty acyl-ACP thioesterase (GenBank #CAN81819)
*Garcinia mangostana* fatty acyl-ACP thioesterase (GenBank #AAB51525)
*Garcinia mangostana* fatty acyl-ACP thioestease (GenBank #AAB51525.1)
*Brassica juncea* fatty acyl-ACP thioesterase (GenBank #ABI18986)
*Madhuca longifolia* fatty acyl-ACP thioesterase (GenBank #AAX51637)
*Brassica napus* fatty acyl-ACP thioesterase (GenBank #ABH11710)
*Brassica napus* fatty acyl-ACP thioesterase (GenBank #CAA52070.1)
*Oryza sativa* (*indica* cultivar-group) fatty acyl-ACP thioesterase (GenBank #EAY86877)
*Oryza sativa* (*japonica* cultivar-group) fatty acyl-ACP thioesterase (GenBank #NP_001068400)
*Oryza sativa* (*indica* cultivar-group) fatty acyl-ACP thioesterase (GenBank #EAY99617)
*Cuphea hookeriana* fatty acyl-ACP thioesterase (GenBank #AAC49269)
*Ulmus Americana* fatty acyl-ACP thioesterase (GenBank #AAB71731)
*Cuphea lanceolata* fatty acyl-ACP thioesterase (GenBank #CAB60830)
*Cuphea palustris* fatty acyl-ACP thioesterase (GenBank #AAC49180)
*Iris germanica* fatty acyl-ACP thioesterase (GenBank #AAG43858)
*Iris germanica* fatty acyl-ACP thioesterase (GenBank #AAG43858.1)
*Cuphea palustris* fatty acyl-ACP thioesterase (GenBank #AAC49179)
*Myristica fragrans* fatty acyl-ACP thioesterase (GenBank #AAB71729)
*Myristica fragrans* fatty acyl-ACP thioesterase (GenBank #AAB717291.1)
*Cuphea hookeriana* fatty acyl-ACP thioesterase (GenBank #U39834)
*Umbelluaria californica* fatty acyl-ACP thioesterase (GenBank #M94159)
*Cinnamomum camphora* fatty acyl-ACP thioesterase (GenBank #U31813)
*Ricinus communis* fatty acyl-ACP thioesterase (GenBank #ABS30422.1)

Examples below describe the successful targeting and expression of heterologous fatty acyl-ACP thioesterases from Cuphea hookeriana, Umbellularia californica, Cinnamomun camphora, Cuphea palustris, Cuphea lanceolata, Iris germanica, Myristica fragrans, Garcinia mangostana, Elaeis guiniensis, Brassica napus, Ricinus communis and Ulmus americana in Prototheca species. Additionally, alterations in fatty acid profiles were confirmed in the host cells expressing these heterologous fatty acyl-ACP thioesterases. As shown in the Examples, the expression of these heterologous thioesterases in Prototheca generates a transgenic microalgae that is able to produce oil/lipids with truly unique fatty acid profiles that are currently not available from commercial seed crops, even through the blending of several seed crop oils. Table 5 shows the fatty acid profiles of common commercial seed oils. All commercial seed oil data below were compiled from the US Pharmacopeias Food and Chemicals Codes, 7$^{th}$ Ed. 2010-2011. Tallow data is from the National Research Council: Fat Content and Composition of Animal Products (1976).

acid (32-47%) containing oil, but palm oil has very little C14:0 fatty acids. Prototheca containing the U. americana thioesterase achieved about 33-38% C16:0 fatty acids and about a 10-16% C14:0 fatty acids (about a 2:1 C16:0 to C14:0 ratio). This fatty acid profile has been commercially impractical through blending of existing oils at a commercial level because the seed oils that are high in 16:0 fatty acids usually do not contain much 14:0 fatty acids.

The Examples below also describe, the successful targeting and expression of at least two fatty acyl-ACP thioesterases in one clone. The alterations in the fatty acid profiles were confirmed in these clones and depending on which two thioesterases were co-expressed in one clone, the fatty acid profiles were impacted in different ways. As an example, from Table 5 above, both coconut oil and palm kernel oil have C12:C14 ratios of roughly 3:1. As described in the Examples below, a Prototheca transformant containing two heterologous thioesterase genes was able to produce

TABLE 5

Lipid profiles of commercial seed oils.

| | C8:0 | C10:0 | C12:0 | C14:0 | C16:0 | C18:0 | C18:1 | C18:0-diOH | C18:1-OH | C18:2 | C18:3 α |
|---|---|---|---|---|---|---|---|---|---|---|---|
| R. communis (Castor oil) | 0 | 0 | 0 | 0 | 0.9-1.6 | 1.0-1.8 | 3.7-6.7 | 0.4-1.3 | 83.6-89.0 | 0 | 0.2-0.6 |
| C. nucifera (Coconut oil) | 5.0-9.0 | 4.0-8.0 | 44-52 | 15-21 | 8.0-11.0 | 1.0-4.0 | 5.0-8.0 | 0 | 0 | 0-2.5 | 0 |
| Z. mays (Corn oil) | 0 | 0 | 0 | <1.0 | 8.0-19.0 | 0.5-4.0 | 19-50 | 0 | 0 | 38-65 | <2.0 |
| G. barbadense (Cottonseed oil) | 0 | 0 | <0.1 | 0.5-2.0 | 17-29 | 1.0-4.0 | 13-44 | 0 | 0 | 40-63 | 0.1-2.1 |
| B. rapa, B napus, B. juncea (Canola) | 0 | 0 | <0.1 | <0.2 | <6.0 | <2.5 | >50 | 0 | 0 | <40 | <14 |
| O. europea (Olive) | 0 | 0 | 0 | <0.1 | 6.5-20.0 | 0.5-5.0 | 56-85 | 0 | 0 | 3.5-20.0 | <1.2 |
| A. hypogaea (Peanut) | 0 | 0 | <0.1 | <0.2 | 7.0-16.0 | 1.3-6.5 | 35-72 | 0 | 0 | 13.0-43 | <0.6 |
| E. guineensis (Palm kernel) | 3.0-5.0 | 2.5-6.0 | 40-52 | 14.0-18.0 | 7.0-10.0 | 1.0-3.0 | 11.0-19.0 | 0 | 0 | 0.5-4.0 | 0 |
| E. guineensis (Palm) | 0 | 0 | 0 | 0.5-5.9 | 32.0-47.0 | 2.0-8.0 | 34-44 | 0 | 0 | 7.2-12.0 | 0 |
| C. tinctorus (Safflower) | 0 | 0 | <0.1 | <0.1 | 2.0-10.0 | 1.0-10.0 | 7.0-16.0 | 0 | 0 | 72-81 | <1.5 |
| H. annus (Sunflower) | 0 | 0 | <0.1 | <0.5 | 3.0-10.0 | 1.0-10.0 | 14-65 | 0 | 0 | 20-75 | <0.5 |
| G. max (Soybean) | 0 | 0 | <0.1 | <0.5 | 7.0-12.0 | 2.0-5.5 | 19-30 | 0 | 0 | 48-65 | 5.0-10.0 |
| L. usitatissimum (Solin-Flax) | 0 | 0 | <0.1 | <0.5 | 2.0-9.0 | 2.0-5.0 | 8.0-60 | 0 | 0 | 40-80 | <5.0 |
| B. parkii (Sheanut) | 0 | 0 | 0 | 0 | 3.8-4.1 | 41.2-56.8 | 34.0-46.9 | 0 | 0 | 3.7-6.5 | 0 |
| Tallow | | | | 4 | 26 | 14 | 41 | | | 3 | 1 |

As an example, none of these common seed oils contain high amounts of C8 or C10 fatty acids, with coconut oil and palm kernel oil being the largest sources, but both having a ratio of about 1:1 (C8:C10 fatty acids). As shown in the Examples, Prototheca transformed with Cuphea palustris C:8 preferring thioesterase was able to achieve not only a C8 fatty acid levels of over 12%, but also, the ratio of C8:C10 fatty acids was about 5:1. Changes in fatty acid levels are useful for producing oils containing a tailored fatty acid profile for a variety of commercial applications. Additionally, changes of ratios between different fatty acid chain lengths is something that has not been available commercially in oils that have not undergone further costly chemical processes (such as esterification, distillation, fractionation, and re-esterification). As another example, palm oil is the highest C16:0 fatty C12:C14 fatty acid levels at a ratio of roughly 5:1. This kind of ratio of C12:C14 fatty acids has been commercially impractical (i.e., through blending of seed oils).

Another novel aspect of the oils produced by transgenic microalgae is the degree of saturation of the fatty acids. Palm oil is currently the largest source of saturated oil, with a total saturates to unsaturates of 52% to 48%. As shown in the Examples below, Prototheca with heterologous thioesterases from U. americana and C. camphora achieved total saturates levels of over 60% in the oil that it produced. Also shown in the Examples below, Prototheca with heterologous thioesterase from U. americana achieved total saturates level of over 86% in the oil that it produced.

Fatty acyl-CoA/aldehyde reductases suitable for use with the microbes and methods of the invention include, without limitation, those listed in Table 6.

TABLE 6

Fatty acyl-CoA/aldehyde reductases listed by GenBank accession numbers.

AAC45217, YP_047869, BAB85476, YP_001086217, YP_580344,
YP_001280274, YP_264583, YP_436109, YP_959769, ZP_01736962,
ZP_01900335, ZP_01892096, ZP_01103974, ZP_01915077, YP_924106,
YP_130411, ZP_01222731, YP_550815, YP_983712, YP_001019688,
YP_524762, YP_856798, ZP_01115500, YP_001141848, NP_336047,
NP_216059, YP_882409, YP_706156, YP_001136150, YP_952365,
ZP_01221833, YP_130076, NP_567936, AAR88762, ABK28586,
NP_197634, CAD30694, NP_001063962, BAD46254, NP_001030809,
EAZ10132, EAZ43639, EAZ07989, NP_001062488, CAB88537,
NP_001052541, CAH66597, CAE02214, CAH66590, CAB88538,
EAZ39844, AAZ06658, CAA68190, CAA52019, and BAC84377

Fatty acyl-CoA reductases suitable for use with the microbes and methods of the invention include, without limitation, those listed in Table 7.

TABLE 7

Fatty acyl-CoA reductases listed by GenBank accession numbers.

NP_187805, ABO14927, NP_001049083, CAN83375, NP_191229,
EAZ42242, EAZ06453, CAD30696, BAD31814, NP_190040, AAD38039,
CAD30692, CAN81280, NP_197642, NP_190041, AAL15288, and
NP_190042

Fatty aldehyde decarbonylases suitable for use with the microbes and methods of the invention include, without limitation, those listed in Table 8.

TABLE 8

Fatty aldehyde decarbonylases listed by GenBank accession numbers.

NP_850932, ABN07985, CAN60676, AAC23640, CAA65199, AAC24373,
CAE03390, ABD28319, NP_181306, EAZ31322, CAN63491, EAY94825,
EAY86731, CAL55686, XP_001420263, EAZ23849, NP_200588,
NP_001063227, CAN83072, AAR90847, and AAR97643

Combinations of naturally co-expressed fatty acyl-ACP thioesterases and acyl carrier proteins are suitable for use with the microbes and methods of the invention.

Additional examples of hydrocarbon or lipid modification enzymes include amino acid sequences contained in, referenced in, or encoded by nucleic acid sequences contained or referenced in, any of the following U.S. Pat. Nos. 6,610,527; 6,451,576; 6,429,014; 6,342,380; 6,265,639; 6,194,185; 6,114,160; 6,083,731; 6,043,072; 5,994,114; 5,891,697; 5,871,988; 6,265,639, and further described in GenBank Accession numbers: AAO18435; ZP_00513891; Q38710; AAK60613; AAK60610; AAK60611; NP_113747; CAB75874; AAK60612; AAF20201; BAA11024; AF205791; and CAA03710.

Other enzymes in the lipid biosynthetic pathways are also suitable for use with microbes and methods of the invention. For example, keto acyl-ACP synthase (Kas) enzymes work in conjunction with some of the above listed enzymes in the lipid biosynthetic pathway. There different classes of Kas enzymes: Kas I participates in successive condensation steps between the ever-growing acyl ACP chains and malonyl-ACP. Kas II typically participates in the final condensation step leading from C16:0-ACP to C18:0-ACP incorporating malonyl-ACP. As such, in higher plants and some microalgae species/strains that synthesize predominantly C16-C18:0 fatty acids (and their unsaturated derivatives), Kas II enzymes interact with products of FatA genes (acyl-ACP thioesterases).

Acyl-ACP liberate growing fatty acid chains from ACP during fatty acid biosynthesis, and in most plant species, this is carried out by members of the FatA gene family, whose role is to terminate elongation at the C16:0 to C18:0 stage. In species that synthesize shorter chain fatty acids (such as *Cuphea, Elaeis, Myristica,* or *Umbellularia*), a different group of acyl-ACP thioesterases encoded by FatB genes carry out this termination step. The interaction between Kas II enzymes and acyl-Acp thioesterases is important for the correct termination of fatty acid chain elongation. As a consequence, in higher plant species (and microalgal species) that have evolved FatB genes capable of shorter chain lipid biosynthesis, there has been a corresponding co-evolution of an additional class of Kas genes, termed Kas IV genes. Kas IV genes are responsible for chain length elongation of a specific size range of fatty acids, 4-14 carbons in length.

Other suitable enzymes for use with the microbes and the methods of the invention include those that have at least 70% amino acid identity with one of the proteins listed in Tables 4, 6-8, and that exhibit the corresponding desired enzymatic activity (e.g., cleavage of a fatty acid from an acyl carrier protein, reduction of an acyl-CoA to an aldehyde or an alcohol, or conversion of an aldehyde to an alkane). In additional embodiments, the enzymatic activity is present in a sequence that has at least about 75%, at least about 80%, at least about 85%, at least about 90%, at least about 95%, or at least about 99% identity with one of the above described sequences, all of which are hereby incorporated by reference as if fully set forth.

By selecting the desired combination of exogenous genes to be expressed, one can tailor the product generated by the microbe, which may then be extracted from the aqueous biomass. For example, the microbe can contain one or more of (i) an exogenous gene encoding a fatty acyl-ACP thioesterase; and, optionally, (ii) a naturally co-expressed acyl carrier protein or an acyl carrier protein otherwise having affinity for the fatty acyl-ACP thioesterase (or conversely); and, optionally, (iii) an exogenous gene encoding a fatty acyl-CoA/aldehyde reductase or a fatty acyl-CoA reductase; and, optionally, (iv) an exogenous gene encoding a fatty aldehyde reductase or a fatty aldehyde decarbonylase. The microbe can also contain one or more of an exogenous stearoil ACP desturase, fatty acid desaturase, β-ketoacyl-ACP synthase I (e.g. as encoded by a KASI gene), a β-ketoacyl-ACP synthase II (e.g. as encoded by a KASII gene), or oleate-12 hydroxylase. The microbe, under culture conditions described herein, synthesizes a fatty acid linked to an ACP and the fatty acyl-ACP thioesterase catalyzes the cleavage of the fatty acid from the ACP to yield, through further enzymatic processing, a fatty acyl-CoA molecule. When present, the fatty acyl-CoA/aldehyde reductase catalyzes the reduction of the acyl-CoA to an alcohol. Similarly, the fatty acyl-CoA reductase, when present, catalyzes the reduction of the acyl-CoA to an aldehyde. In those embodiments in which an exogenous gene encoding a fatty acyl-CoA reductase is present and expressed to yield an aldehyde product, a fatty aldehyde reductase, encoded by the third exogenous gene, catalyzes the reduction of the aldehyde to an alcohol Similarly, a fatty aldehyde decarbonylase catalyzes the conversion of the aldehyde to an alkane or an alkene, when present.

In another embodiment, the microbe can contain: (i) an exogenous gene encoding a fatty acyl-ACP thioesterase; (ii) optionally, a naturally co-expressed acyl carrier protein or an acyl carrier protein having affinity for the fatty acid acyl-ACP thioesterase; (iii) a mutated endogenous desaturase gene, wherein the mutation renders the desaturase gene or desaturase protein inactive, such as a desaturase knockout or a a desaturase suppression element such as a targeted RNAi, antisense or dsRNA construct; (iv) overexpression of an endogenous stearoyl acyl carrier protein desaturase or the expression of a heterologous SAD; and (v) any combination of the foregoing.

Genes encoding such enzymes, such as fatty acyl ACP thioesterases, can be obtained from cells already known to exhibit significant lipid production such as *Chlorella protothecoides*. Genes already known to have a role in lipid production, e.g., a gene encoding an enzyme that saturates double bonds, can be transformed individually into recipient cells. However, to practice the invention it is not necessary to make a priori assumptions as to which genes are required. Methods for identifying genes that can alter (improve) lipid production in microalgae are described in PCT Pub. No. 2008/151149.

Thus, the present invention provides a *Prototheca* cell that has been genetically engineered to express a lipid pathway enzyme at an altered level compared to a wild-type cell of the same species. In some cases, the cell produces more lipid compared to the wild-type cell when both cells are grown under the same conditions. In some cases, the cell has been genetically engineered and/or selected to express a lipid pathway enzyme at a higher level or a lower level than the wild-type cell. In some cases, the lipid pathway enzyme is selected from the group consisting of pyruvate dehydrogenase, acetyl-CoA carboxylase, acyl carrier protein, and glycerol-3 phosphate acyltransferase. In some cases, the cell has been genetically engineered and/or selected to express a lipid pathway enzyme at a lower level than the wild-type cell. In at least one embodiment in which the cell expresses the lipid pathway enzyme at a lower level, the lipid pathway enzyme comprises citrate synthase.

In some embodiments, the cell has been genetically engineered and/or selected to express a global regulator of fatty acid synthesis at an altered level compared to the wild-type cell, whereby the expression levels of a plurality of fatty acid synthetic genes are altered compared to the wild-type cell. In some cases, the lipid pathway enzyme comprises an enzyme that modifies a fatty acid. In some cases, the lipid pathway enzyme is selected from a stearoyl-ACP desaturase and a glycerolipid desaturase. In some cases, the cell has been genetically engineered and/or selected to express a lower level of a lipid pathway enzyme, or not to express a specific lipid pathway enzyme at all (i.e., wherein a lipid pathway enzyme has been knockout, replaced with an exogenous gene, or expression has been reduced using RNAi or antisense methods). In another embodiment, the lipid pathway enzyme is the heterologous expression of a desaturase gene, including but not limited to a stearoyl-ACP desaturase or a fatty acid desaturase (FAD). Example 6 describes the expression of a heterologous stearoyl-ACP from *Olea europaea* in a *Prototheca moriformis* genetic background.

In other embodiments, the present invention is directed to an oil-producing microbe containing one or more exogenous genes, wherein the exogenous genes encode protein(s) selected from the group consisting of a fatty acyl-ACP thioesterase, a fatty acyl-CoA reductase, a fatty aldehyde reductase, a fatty acyl-CoA/aldehyde reductase, a fatty aldehyde decarbonylase, a desaturase, and an acyl carrier protein. In another embodiment, an endogenous desaturase gene is overexpressed in a microbe containing one or more of the above exogenous genes. In one embodiment, the exogenous gene is in operable linkage with a promoter, which is inducible or repressible in response to a stimulus. In some cases, the stimulus is selected from the group consisting of an exogenously provided small molecule, heat, cold, and limited or no nitrogen in the culture media. In some cases, the exogenous gene is expressed in a cellular compartment. In some embodiments, the cellular compartment is selected from the group consisting of a chloroplast, a plastid and a mitochondrion. In some embodiments the microbe is *Prototheca moriformis, Prototheca krugani, Prototheca stagnora* or *Prototheca zopfii*.

In one embodiment, the exogenous gene encodes a fatty acid acyl-ACP thioesterase. In some cases, the thioesterase encoded by the exogenous gene catalyzes the cleavage of an 8 to 18-carbon fatty acid from an acyl carrier protein (ACP). In some cases, the thioesterase encoded by the exogenous gene catalyzes the cleavage of a 10 to 14-carbon fatty acid from an ACP. In one embodiment, the thioesterase encoded by the exogenous gene catalyzes the cleavage of a 12-carbon fatty acid from an ACP.

In one embodiment, the exogenous gene encodes a fatty acyl-CoA/aldehyde reductase. In some cases, the reductase encoded by the exogenous gene catalyzes the reduction of an 8 to 18-carbon fatty acyl-CoA to a corresponding primary alcohol. In some cases, the reductase encoded by the exogenous gene catalyzes the reduction of a 10 to 14-carbon fatty acyl-CoA to a corresponding primary alcohol. In one embodiment, the reductase encoded by the exogenous gene catalyzes the reduction of a 12-carbon fatty acyl-CoA to dodecanol.

The present invention also provides a recombinant *Prototheca* or other cell containing two exogenous genes, wherein a first exogenous gene encodes a fatty acyl-ACP thioesterase and a second exogenous gene encodes a protein selected from the group consisting of a fatty acyl-CoA reductase, a fatty acyl-CoA/aldehyde reductase, and an acyl carrier protein. In some cases, the two exogenous genes are each in operable linkage with a promoter, which is inducible in response to a stimulus. In some cases, each promoter is inducible in response to an identical stimulus, such as limited or no nitrogen in the culture media. Limitation or complete lack of nitrogen in the culture media stimulates oil production in some microorganisms such as *Prototheca* species, and can be used as a trigger to induce oil production to high levels. When used in combination with the genetic engineering methods disclosed herein, the lipid as a percentage of dry cell weight can be pushed to high levels such as at least 30%, at least 40%, at least 50%, at least 60%, at least 70% at least 75%, at least 80%, at least 85% or between 75 to 90%; methods disclosed herein provide for cells with these levels of lipid, wherein the lipid is at least 4% C8-C14, at least 0.3% C8, at least 2% C10, at least 2% C12, and at least 2% C14. In some embodiments the cells are over 25% lipid by dry cell weight and contain lipid that is at least 10% C8-C14, at least 20% C8-C14, at least 30% C8-C14, 10-30% C8-C14 and 20-30% C8-C14.

The novel oils disclosed herein are distinct from other naturally occurring oils that are high in mid-chain fatty acids, such as palm oil, palm kernel oil, and coconut oil. For example, levels of contaminants such as carotenoids are far higher in palm oil and palm kernel oil than in the oils of the invention. Palm and palm kernel oils in particular contain alpha and beta carotenes and lycopene in much higher amounts than is in the oils of the invention. In addition, over 20 different carotenoids are found in palm and palm kernel oil, whereas the Examples demonstrate that the oils of the invention contain very few carotenoids species and very low levels. In addition, the levels of vitamin E compounds such as tocotrienols are far higher in palm, palm kernel, and coconut oil than in the oils of the invention.

In one embodiment, the thioesterase encoded by the first exogenous gene catalyzes the cleavage of an 8 to 18-carbon fatty acid from an ACP. In some embodiments, the second exogenous gene encodes a fatty acyl-CoA/aldehyde reductase which catalyzes the reduction of an 8 to 18-carbon fatty acyl-CoA to a corresponding primary alcohol. In some cases, the thioesterase encoded by the first exogenous gene catalyzes the cleavage of a 10 to 14-carbon fatty acid from an ACP, and the reductase encoded by the second exogenous gene catalyzes the reduction of a 10 to 14-carbon fatty acyl-CoA to the corresponding primary alcohol, wherein the thioesterase and the reductase act on the same carbon chain length. In one embodiment, the thioesterase encoded by the first exogenous gene catalyzes the cleavage of a 12-carbon fatty acid from an ACP, and the reductase encoded by the second exogenous gene catalyzes the reduction of a 12-carbon fatty acyl-CoA to dodecanol. In some embodiments, the second exogenous gene encodes a fatty acyl-CoA reductase which catalyzes the reduction of an 8 to 18-carbon fatty acyl-CoA to a corresponding aldehyde. In some embodiments, the second exogenous gene encodes an acyl carrier protein that is naturally co-expressed with the fatty acyl-ACP thioesterase.

In some embodiments, the second exogenous gene encodes a fatty acyl-CoA reductase, and the microbe further contains a third exogenous gene encoding a fatty aldehyde decarbonylase. In some cases, the thioesterase encoded by the first exogenous gene catalyzes the cleavage of an 8 to 18-carbon fatty acid from an ACP, the reductase encoded by the second exogenous gene catalyzes the reduction of an 8 to 18-carbon fatty acyl-CoA to a corresponding fatty aldehyde, and the decarbonylase encoded by the third exogenous gene catalyzes the conversion of an 8 to 18-carbon fatty aldehyde to a corresponding alkane, wherein the thioesterase, the reductase, and the decarbonylase act on the same carbon chain length.

In some embodiments, the second exogenous gene encodes an acyl carrier protein, and the microbe further contains a third exogenous gene encoding a protein selected from the group consisting of a fatty acyl-CoA reductase and a fatty acyl-CoA/aldehyde reductase. In some cases, the third exogenous gene encodes a fatty acyl-CoA reductase, and the microbe further contains a fourth exogenous gene encoding a fatty aldehyde decarbonylase.

The present invention also provides methods for producing an alcohol comprising culturing a population of recombinant Prototheca cells in a culture medium, wherein the cells contain (i) a first exogenous gene encoding a fatty acyl-ACP thioesterase, and (ii) a second exogenous gene encoding a fatty acyl-CoA/aldehyde reductase, and the cells synthesize a fatty acid linked to an acyl carrier protein (ACP), the fatty acyl-ACP thioesterase catalyzes the cleavage of the fatty acid from the ACP to yield, through further processing, a fatty acyl-CoA, and the fatty acyl-CoA/aldehyde reductase catalyzes the reduction of the acyl-CoA to an alcohol.

The present invention also provides methods of producing a lipid molecule in a Prototheca cell. In one embodiment, the method comprises culturing a population of Prototheca cells in a culture medium, wherein the cells contain (i) a first exogenous gene encoding a fatty acyl-ACP thioesterase, and (ii) a second exogenous gene encoding a fatty acyl-CoA reductase, and wherein the microbes synthesize a fatty acid linked to an acyl carrier protein (ACP), the fatty acyl-ACP thioesterase catalyzes the cleavage of the fatty acid from the ACP to yield, through further processing, a fatty acyl-CoA, and the fatty acyl-CoA reductase catalyzes the reduction of the acyl-CoA to an aldehyde.

The present invention also provides methods of producing a fatty acid molecule having a specified carbon chain length in a Prototheca cell. In one embodiment, the method comprises culturing a population of lipid-producing Prototheca cells in a culture medium, wherein the microbes contain an exogenous gene encoding a fatty acyl-ACP thioesterase having an activity specific or preferential to a certain carbon chain length, such as 8, 10, 12 or 14 carbon atoms, and wherein the microbes synthesize a fatty acid linked to an acyl carrier protein (ACP) and the thioesterase catalyzes the cleavage of the fatty acid from the ACP when the fatty acid has been synthesized to the specific carbon chain length.

In the various embodiments described above, the Prototheca cell can contain at least one exogenous gene encoding a lipid pathway enzyme or a suppression element such as an RNA interference element that suppresses expression of the gene product. In some cases, the lipid pathway enzyme is selected from the group consisting of a stearoyl-ACP desaturase, a glycerolipid desaturase, a pyruvate dehydrogenase, an acetyl-CoA carboxylase, an acyl carrier protein, and a glycerol-3 phosphate acyltransferase. In other cases, the Prototheca cell contains a lipid modification enzyme selected from the group consisting of a fatty acyl-ACP thioesterase, a fatty acyl-CoA/aldehyde reductase, a fatty acyl-CoA reductase, a fatty aldehyde reductase, a fatty aldehyde decarbonylase, and/or an acyl carrier protein.

The present invention also provides for a microbial cell that contains a heterologous gene that encodes a hydroxylase that generates a hydroxylated fatty acid. The microbial cell may comprise a type II fatty acid synthesis pathway. For example, the microbial cell may be a microalgal cell. In some embodiments, the microalgal cell is selected from the microalgal cells listed in Table 1 above. In other embodiments the microalgal cell is of the genus Prototheca. In still other embodiments, the microalgal cell is Prototheca moriformis. Hydroxylases are enzymes that adds a hydroxyl group (—OH) onto a substrate. Fatty acid hydroxylases are naturally occurring enzymes found in some higher plants. A non-limiting example of a naturally occurring hydroxylase found in a higher plant is the oleate 12-hydroxylase from Ricinus communis which is responsible for the production of ricinoleic acid. Example 7 describes an example of the heterologous expression of a hydroxylase in Prototheca cells, specifically, the expression of Ricinus communis oleate 12-hydroxlase in Prototheca moriformis cells.

VI. FUELS AND CHEMICALS PRODUCTION

For the production of fuel in accordance with the methods of the invention lipids produced by cells of the invention are harvested, or otherwise collected, by any convenient means. Lipids can be isolated by whole cell extraction. The cells are first disrupted, and then intracellular and cell membrane/cell wall-associated lipids as well as extracellular hydrocarbons can be separated from the cell mass, such as by use of centrifugation as described above. Intracellular lipids produced in microorganisms are, in some embodiments, extracted after lysing the cells of the microorganism. Once extracted, the lipids are further refined to produce oils, fuels, or oleochemicals.

After completion of culturing, the microorganisms can be separated from the fermentation broth. Optionally, the separation is effected by centrifugation to generate a concentrated paste. Centrifugation does not remove significant amounts of intracellular water from the microorganisms and is not a drying step. The biomass can then optionally be washed with a washing solution (e.g., DI water) to get rid of the fermentation broth and debris. Optionally, the washed microbial biomass may also be dried (oven dried, lyophilized, etc.) prior to cell disruption. Alternatively, cells can be lysed without separation from some or all of the fermentation broth when the fermentation is complete. For example, the cells can be at a ratio of less than 1:1 v:v cells to extracellular liquid when the cells are lysed.

Microorganisms containing a lipid can be lysed to produce a lysate. As detailed herein, the step of lysing a microorganism (also referred to as cell lysis) can be achieved by any convenient means, including heat-induced lysis, adding a base, adding an acid, using enzymes such as proteases and polysaccharide degradation enzymes such as amylases, using ultrasound, mechanical lysis, using osmotic shock, infection with a lytic virus, and/or expression of one or more lytic genes. Lysis is performed to release intracellular molecules which have been produced by the microorganism. Each of these methods for lysing a microorganism can be used as a single method or in combination simultaneously or sequentially. The extent of cell disruption can be observed by microscopic analysis. Using one or more of the methods described herein, typically more than 70% cell breakage is observed. Preferably, cell breakage is more than 80%, more preferably more than 90% and most preferred about 100%.

In particular embodiments, the microorganism is lysed after growth, for example to increase the exposure of cellular lipid and/or hydrocarbon for extraction or further processing. The timing of lipase expression (e.g., via an inducible promoter) or cell lysis can be adjusted to optimize the yield of lipids and/or hydrocarbons. Below are described a number of lysis techniques. These techniques can be used individually or in combination.

In one embodiment of the present invention, the step of lysing a microorganism comprises heating of a cellular suspension containing the microorganism. In this embodiment, the fermentation broth containing the microorganisms (or a suspension of microorganisms isolated from the fermentation broth) is heated until the microorganisms, i.e., the cell walls and membranes of microorganisms degrade or breakdown. Typically, temperatures applied are at least 50° C. Higher temperatures, such as, at least 30° C. at least 60° C., at least 70° C., at least 80° C., at least 90° C., at least 100° C., at least 110° C., at least 120° C., at least 130° C. or higher are used for more efficient cell lysis. Lysing cells by heat treatment can be performed by boiling the microorganism. Alternatively, heat treatment (without boiling) can be performed in an autoclave. The heat treated lysate may be cooled for further treatment. Cell disruption can also be performed by steam treatment, i.e., through addition of pressurized steam. Steam treatment of microalgae for cell disruption is described, for example, in U.S. Pat. No. 6,750,048. In some embodiments, steam treatment may be achieved by sparging steam into the fermentor and maintaining the broth at a desired temperature for less than about 90 minutes, preferably less than about 60 minutes, and more preferably less than about 30 minutes.

In another embodiment of the present invention, the step of lysing a microorganism comprises adding a base to a cellular suspension containing the microorganism. The base should be strong enough to hydrolyze at least a portion of the proteinaceous compounds of the microorganisms used. Bases which are useful for solubilizing proteins are known in the art of chemistry. Exemplary bases which are useful in the methods of the present invention include, but are not limited to, hydroxides, carbonates and bicarbonates of lithium, sodium, potassium, calcium, and mixtures thereof. A preferred base is KOH. Base treatment of microalgae for cell disruption is described, for example, in U.S. Pat. No. 6,750,048.

In another embodiment of the present invention, the step of lysing a microorganism comprises adding an acid to a cellular suspension containing the microorganism. Acid lysis can be effected using an acid at a concentration of 10-500 mN or preferably 40-160 nM. Acid lysis is preferably performed at above room temperature (e.g., at 40-160°, and preferably a temperature of 50-130°. For moderate temperatures (e.g., room temperature to 100° C. and particularly room temperature to 65°, acid treatment can usefully be combined with sonication or other cell disruption methods.

In another embodiment of the present invention, the step of lysing a microorganism comprises lysing the microorganism by using an enzyme. Preferred enzymes for lysing a microorganism are proteases and polysaccharide-degrading enzymes such as hemicellulase (e.g., hemicellulase from *Aspergillus niger*; Sigma Aldrich, St. Louis, Mo.; #H2125), pectinase (e.g., pectinase from *Rhizopus* sp.; Sigma Aldrich, St. Louis, Mo.; #P2401), Mannaway 4.0 L (Novozymes), cellulase (e.g., cellulose from *Trichoderma viride*; Sigma Aldrich, St. Louis, Mo.; #C9422), and driselase (e.g., driselase from *Basidiomycetes* sp.; Sigma Aldrich, St. Louis, Mo.; #D9515.

In other embodiments of the present invention, lysis is accomplished using an enzyme such as, for example, a cellulase such as a polysaccharide-degrading enzyme, optionally from *Chlorella* or a *Chlorella* virus, or a proteases, such as *Streptomyces griseus* protease, chymotrypsin, proteinase K, proteases listed in Degradation of Polylactide by Commercial Proteases, Oda Y et al., Journal of Polymers and the Environment, Volume 8, Number 1, January 2000, pp. 29-32 (4), Alcalase 2.4 FG (Novozymes), and Flavourzyme 100 L (Novozymes). Any combination of a protease and a polysaccharide-degrading enzyme can also be used, including any combination of the preceding proteases and polysaccharide-degrading enzymes.

In another embodiment, lysis can be performed using an expeller press. In this process, biomass is forced through a screw-type device at high pressure, lysing the cells and causing the intracellular lipid to be released and separated from the protein and fiber (and other components) in the cell.

In another embodiment of the present invention, the step of lysing a microorganism is performed by using ultrasound, i.e., sonication. Thus, cells can also by lysed with high frequency sound. The sound can be produced electronically and transported through a metallic tip to an appropriately concentrated cellular suspension. This sonication (or ultrasonication) disrupts cellular integrity based on the creation of cavities in cell suspension.

In another embodiment of the present invention, the step of lysing a microorganism is performed by mechanical lysis. Cells can be lysed mechanically and optionally homogenized to facilitate hydrocarbon (e.g., lipid) collection. For example, a pressure disrupter can be used to pump a cell containing slurry through a restricted orifice valve. High pressure (up to 1500 bar) is applied, followed by an instant expansion through an exiting nozzle. Cell disruption is accomplished by three different mechanisms: impingement on the valve, high liquid shear in the orifice, and sudden pressure drop upon discharge, causing an explosion of the cell. The method releases intracellular molecules. Alternatively, a ball mill can be used. In a ball mill, cells are agitated in suspension with small abrasive particles, such as beads. Cells break because of shear forces, grinding between beads, and collisions with beads. The beads disrupt the cells to release cellular contents. Cells can also be disrupted by shear forces, such as with the use of blending (such as with a high speed or Waring blender as examples), the french press, or even centrifugation in case of weak cell walls, to disrupt cells.

In another embodiment of the present invention, the step of lysing a microorganism is performed by applying an osmotic shock.

In another embodiment of the present invention, the step of lysing a microorganism comprises infection of the microorganism with a lytic virus. A wide variety of viruses are known to lyse microorganisms suitable for use in the present invention, and the selection and use of a particular lytic virus for a particular microorganism is within the level of skill in the art. For example, *paramecium bursaria chlorella* virus (PBCV-1) is the prototype of a group (family Phycodnaviridae, genus *Chlorovirus*) of large, icosahedral, plaque-forming, double-stranded DNA viruses that replicate in, and lyse, certain unicellular, eukaryotic chlorella-like green algae. Accordingly, any susceptible microalgae can be lysed by infecting the culture with a suitable chlorella virus. Methods of infecting species of *Chlorella* with a *chlorella* virus are known. See for example *Adv. Virus Res.* 2006; 66:293-336; *Virology,* 1999 Apr. 25; 257(1):15-23; *Virology,* 2004 Jan. 5; 318(1):214-23; *Nucleic Acids Symp. Ser.* 2000; (44):161-2; *J. Virol.* 2006 March; 80(5):2437-44; and *Annu. Rev. Microbiol.* 1999; 53:447-94.

In another embodiment of the present invention, the step of lysing a microorganism comprises autolysis. In this embodiment, a microorganism according to the invention is genetically engineered to produce a lytic protein that will lyse the microorganism. This lytic gene can be expressed using an inducible promoter so that the cells can first be grown to a desirable density in a fermentor, followed by induction of the promoter to express the lytic gene to lyse the cells. In one embodiment, the lytic gene encodes a polysaccharide-degrading enzyme. In certain other embodiments, the lytic gene is a gene from a lytic virus. Thus, for example, a lytic gene from a *Chlorella* virus can be expressed in an algal cell; see *Virology* 260, 308-315 (1999); *FEMS Microbiology Letters* 180 (1999) 45-53; *Virology* 263, 376-387 (1999); and *Virology* 230, 361-368 (1997). Expression of lytic genes is preferably done using an inducible promoter, such as a promoter active in microalgae that is induced by a stimulus such as the presence of a small molecule, light, heat, and other stimuli.

Various methods are available for separating lipids from cellular lysates produced by the above methods. For example, lipids and lipid derivatives such as fatty aldehydes, fatty alcohols, and hydrocarbons such as alkanes can be extracted with a hydrophobic solvent such as hexane (see Frenz et al. 1989, Enzyme Microb. Technol., 11:717). Lipids and lipid derivatives can also be extracted using liquefaction (see for example Sawayama et al. 1999, Biomass and Bioenergy 17:33-39 and Inoue et al. 1993, Biomass Bioenergy 6(4):269-274); oil liquefaction (see for example Minowa et al. 1995, Fuel 74(12): 1735-1738); and supercritical $CO_2$ extraction (see for example Mendes et al. 2003, Inorganica Chimica Acta 356: 328-334). Miao and Wu describe a protocol of the recovery of microalgal lipid from a culture of *Chlorella protothecoides* in which the cells were harvested by centrifugation, washed with distilled water and dried by freeze drying. The resulting cell powder was pulverized in a mortar and then extracted with n-hexane. Miao and Wu, Biosource Technology (2006) 97:841-846.

Thus, lipids, lipid derivatives and hydrocarbons generated by the microorganisms of the present invention can be recovered by extraction with an organic solvent. In some cases, the preferred organic solvent is hexane. Typically, the organic solvent is added directly to the lysate without prior separation of the lysate components. In one embodiment, the lysate generated by one or more of the methods described above is contacted with an organic solvent for a period of time sufficient to allow the lipid and/or hydrocarbon components to form a solution with the organic solvent. In some cases, the solution can then be further refined to recover specific desired lipid or hydrocarbon components. Hexane extraction methods are well known in the art.

Lipids and lipid derivatives such as fatty aldehydes, fatty alcohols, and hydrocarbons such as alkanes produced by cells as described herein can be modified by the use of one or more enzymes, including a lipase, as described above. When the hydrocarbons are in the extracellular environment of the cells, the one or more enzymes can be added to that environment under conditions in which the enzyme modifies the hydrocarbon or completes its synthesis from a hydrocarbon precursor. Alternatively, the hydrocarbons can be partially, or completely, isolated from the cellular material before addition of one or more catalysts such as enzymes. Such catalysts are exogenously added, and their activity occurs outside the cell or in vitro.

Thus, lipids and hydrocarbons produced by cells in vivo, or enzymatically modified in vitro, as described herein can be optionally further processed by conventional means. The processing can include "cracking" to reduce the size, and thus increase the hydrogen:carbon ratio, of hydrocarbon molecules. Catalytic and thermal cracking methods are routinely used in hydrocarbon and triglyceride oil processing. Catalytic methods involve the use of a catalyst, such as a solid acid catalyst. The catalyst can be silica-alumina or a zeolite, which result in the heterolytic, or asymmetric, breakage of a carbon-carbon bond to result in a carbocation and a hydride anion. These reactive intermediates then undergo either rearrangement or hydride transfer with another hydrocarbon. The reactions can thus regenerate the intermediates to result in a self-propagating chain mechanism. Hydrocarbons can also be processed to reduce, optionally to zero, the number of carbon-carbon double, or triple, bonds therein. Hydrocarbons can also be processed to remove or eliminate a ring or cyclic structure therein. Hydrocarbons can also be processed to increase the hydrogen:carbon ratio. This can include the addition of hydrogen ("hydrogenation") and/or the "cracking" of hydrocarbons into smaller hydrocarbons.

Thermal methods involve the use of elevated temperature and pressure to reduce hydrocarbon size. An elevated temperature of about 800° C. and pressure of about 700 kPa can be used. These conditions generate "light," a term that is sometimes used to refer to hydrogen-rich hydrocarbon molecules (as distinguished from photon flux), while also generating, by condensation, heavier hydrocarbon molecules which are relatively depleted of hydrogen. The methodology provides homolytic, or symmetrical, breakage and produces alkenes, which may be optionally enzymatically saturated as described above.

Catalytic and thermal methods are standard in plants for hydrocarbon processing and oil refining. Thus hydrocarbons produced by cells as described herein can be collected and processed or refined via conventional means. See Hillen et al. (Biotechnology and Bioengineering, Vol. XXIV:193-205 (1982)) for a report on hydrocracking of microalgae-produced hydrocarbons. In alternative embodiments, the fraction is treated with another catalyst, such as an organic compound, heat, and/or an inorganic compound. For processing of lipids into biodiesel, a transesterification process is used as described below in this Section.

Hydrocarbons produced via methods of the present invention are useful in a variety of industrial applications. For example, the production of linear alkylbenzene sulfonate (LAS), an anionic surfactant used in nearly all types of detergents and cleaning preparations, utilizes hydrocarbons generally comprising a chain of 10-14 carbon atoms. See, for example, U.S. Pat. Nos. 6,946,430; 5,506,201; 6,692,730;

6,268,517; 6,020,509; 6,140,302; 5,080,848; and 5,567,359. Surfactants, such as LAS, can be used in the manufacture of personal care compositions and detergents, such as those described in U.S. Pat. Nos. 5,942,479; 6,086,903; 5,833,999; 6,468,955; and 6,407,044.

Increasing interest is directed to the use of hydrocarbon components of biological origin in fuels, such as biodiesel, renewable diesel, and jet fuel, since renewable biological starting materials that may replace starting materials derived from fossil fuels are available, and the use thereof is desirable. There is an urgent need for methods for producing hydrocarbon components from biological materials. The present invention fulfills this need by providing methods for production of biodiesel, renewable diesel, and jet fuel using the lipids generated by the methods described herein as a biological material to produce biodiesel, renewable diesel, and jet fuel.

Traditional diesel fuels are petroleum distillates rich in paraffinic hydrocarbons. They have boiling ranges as broad as 370° to 780° F., which are suitable for combustion in a compression ignition engine, such as a diesel engine vehicle. The American Society of Testing and Materials (ASTM) establishes the grade of diesel according to the boiling range, along with allowable ranges of other fuel properties, such as cetane number, cloud point, flash point, viscosity, aniline point, sulfur content, water content, ash content, copper strip corrosion, and carbon residue. Technically, any hydrocarbon distillate material derived from biomass or otherwise that meets the appropriate ASTM specification can be defined as diesel fuel (ASTM D975), jet fuel (ASTM D1655), or as biodiesel if it is a fatty acid methyl ester (ASTM D6751).

After extraction, lipid and/or hydrocarbon components recovered from the microbial biomass described herein can be subjected to chemical treatment to manufacture a fuel for use in diesel vehicles and jet engines.

Biodiesel is a liquid which varies in color—between golden and dark brown—depending on the production feedstock. It is practically immiscible with water, has a high boiling point and low vapor pressure. Biodiesel refers to a diesel-equivalent processed fuel for use in diesel-engine vehicles. Biodiesel is biodegradable and non-toxic. An additional benefit of biodiesel over conventional diesel fuel is lower engine wear. Typically, biodiesel comprises C14-C18 alkyl esters. Various processes convert biomass or a lipid produced and isolated as described herein to diesel fuels. A preferred method to produce biodiesel is by transesterification of a lipid as described herein. A preferred alkyl ester for use as biodiesel is a methyl ester or ethyl ester.

Biodiesel produced by a method described herein can be used alone or blended with conventional diesel fuel at any concentration in most modern diesel-engine vehicles. When blended with conventional diesel fuel (petroleum diesel), biodiesel may be present from about 0.1% to about 99.9%. Much of the world uses a system known as the "B" factor to state the amount of biodiesel in any fuel mix. For example, fuel containing 20% biodiesel is labeled B20. Pure biodiesel is referred to as B100.

Biodiesel can also be used as a heating fuel in domestic and commercial boilers. Existing oil boilers may contain rubber parts and may require conversion to run on biodiesel. The conversion process is usually relatively simple, involving the exchange of rubber parts for synthetic parts due to biodiesel being a strong solvent. Due to its strong solvent power, burning biodiesel will increase the efficiency of boilers. Biodiesel can be used as an additive in formulations of diesel to increase the lubricity of pure Ultra-Low Sulfur Diesel (ULSD) fuel, which is advantageous because it has virtually no sulfur content. Biodiesel is a better solvent than petrodiesel and can be used to break down deposits of residues in the fuel lines of vehicles that have previously been run on petrodiesel.

Biodiesel can be produced by transesterification of triglycerides contained in oil-rich biomass. Thus, in another aspect of the present invention a method for producing biodiesel is provided. In a preferred embodiment, the method for producing biodiesel comprises the steps of (a) cultivating a lipid-containing microorganism using methods disclosed herein (b) lysing a lipid-containing microorganism to produce a lysate, (c) isolating lipid from the lysed microorganism, and (d) transesterifying the lipid composition, whereby biodiesel is produced. Methods for growth of a microorganism, lysing a microorganism to produce a lysate, treating the lysate in a medium comprising an organic solvent to form a heterogeneous mixture and separating the treated lysate into a lipid composition have been described above and can also be used in the method of producing biodiesel.

The lipid profile of the biodiesel is usually highly similar to the lipid profile of the feedstock oil. Other oils provided by the methods and compositions of the invention can be subjected to transesterification to yield biodiesel with lipid profiles including (a) at least 4% C8-C14; (b) at least 0.3% C8; (c) at least 2% C10; (d) at least 2% C12; and (3) at least 30% C8-C14.

Lipid compositions can be subjected to transesterification to yield long-chain fatty acid esters useful as biodiesel. Preferred transesterification reactions are outlined below and include base catalyzed transesterification and transesterification using recombinant lipases. In a base-catalyzed transesterification process, the triacylglycerides are reacted with an alcohol, such as methanol or ethanol, in the presence of an alkaline catalyst, typically potassium hydroxide. This reaction forms methyl or ethyl esters and glycerin (glycerol) as a byproduct.

Animal and plant oils are typically made of triglycerides which are esters of free fatty acids with the trihydric alcohol, glycerol. In transesterification, the glycerol in a triacylglyceride (TAG) is replaced with a short-chain alcohol such as methanol or ethanol. A typical reaction scheme is as follows:

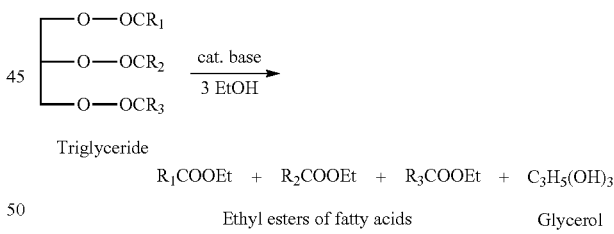

In this reaction, the alcohol is deprotonated with a base to make it a stronger nucleophile. Commonly, ethanol or methanol is used in vast excess (up to 50-fold). Normally, this reaction will proceed either exceedingly slowly or not at all. Heat, as well as an acid or base can be used to help the reaction proceed more quickly. The acid or base are not consumed by the transesterification reaction, thus they are not reactants but catalysts. Almost all biodiesel has been produced using the base-catalyzed technique as it requires only low temperatures and pressures and produces over 98% conversion yield (provided the starting oil is low in moisture and free fatty acids).

Transesterification has also been carried out, as discussed above, using an enzyme, such as a lipase instead of a base. Lipase-catalyzed transesterification can be carried out, for example, at a temperature between the room temperature and 80° C., and a mole ratio of the TAG to the lower alcohol of greater than 1:1, preferably about 3:1. Lipases suitable for use in transesterification include, but are not limited to, those listed in Table 9. Other examples of lipases useful for transesterification are found in, e.g. U.S. Pat. Nos. 4,798,793; 4,940,845 5,156,963; 5,342,768; 5,776,741 and WO89/01032. Such lipases include, but are not limited to, lipases produced by microorganisms of *Rhizopus, Aspergillus, Candida, Mucor, Pseudomonas, Rhizomucor, Candida,* and *Humicola* and pancreas lipase.

TABLE 9

Lipases suitable for use in transesterification.

*Aspergillus niger* lipase ABG73614, *Candida antarctica* lipase B (novozym-435) CAA83122, *Candida cylindracea* lipase AAR24090, *Candida lipolytica* lipase (Lipase L; Amano Pharmaceutical Co., Ltd.), *Candida rugosa* lipase (e.g., Lipase-OF; Meito Sangyo Co., Ltd.), *Mucor miehei* lipase (Lipozyme IM 20), *Pseudomonas fluorescens* lipase AAA25882, *Rhizopus japonicas* lipase (Lilipase A-10FG) Q7M4U7_1, *Rhizomucor miehei* lipase B34959, *Rhizopus oryzae* lipase (Lipase F) AAF32408, *Serratia marcescens* lipase (SM Enzyme) ABI13521, *Thermomyces lanuginosa* lipase CAB58509, Lipase P (Nagase ChemteX Corporation), and Lipase QLM (Meito Sangyo Co., Ltd., Nagoya, Japan)

One challenge to using a lipase for the production of fatty acid esters suitable for biodiesel is that the price of lipase is much higher than the price of sodium hydroxide (NaOH) used by the strong base process. This challenge has been addressed by using an immobilized lipase, which can be recycled. However, the activity of the immobilized lipase must be maintained after being recycled for a minimum number of cycles to allow a lipase-based process to compete with the strong base process in terms of the production cost. Immobilized lipases are subject to poisoning by the lower alcohols typically used in transesterification. U.S. Pat. No. 6,398,707 (issued Jun. 4, 2002 to Wu et al.) describes methods for enhancing the activity of immobilized lipases and regenerating immobilized lipases having reduced activity. Some suitable methods include immersing an immobilized lipase in an alcohol having a carbon atom number not less than 3 for a period of time, preferably from 0.5-48 hours, and more preferably from 0.5-1.5 hours. Some suitable methods also include washing a deactivated immobilized lipase with an alcohol having a carbon atom number not less than 3 and then immersing the deactivated immobilized lipase in a vegetable oil for 0.5-48 hours.

In particular embodiments, a recombinant lipase is expressed in the same microorganisms that produce the lipid on which the lipase acts. Suitable recombinant lipases include those listed above in Table 9 and/or having GenBank Accession numbers listed above in Table 9, or a polypeptide that has at least 70% amino acid identity with one of the lipases listed above in Table 9 and that exhibits lipase activity. In additional embodiments, the enzymatic activity is present in a sequence that has at least about 75%, at least about 80%, at least about 85%, at least about 90%, at least about 95%, or at least about 99% identity with one of the above described sequences, all of which are hereby incorporated by reference as if fully set forth. DNA encoding the lipase and selectable marker is preferably codon-optimized cDNA. Methods of recoding genes for expression in microalgae are described in U.S. Pat. No. 7,135,290.

The common international standard for biodiesel is EN 14214. ASTM D6751 is the most common biodiesel standard referenced in the United States and Canada. Germany uses DIN EN 14214 and the UK requires compliance with BS EN 14214. Basic industrial tests to determine whether the products conform to these standards typically include gas chromatography, HPLC, and others. Biodiesel meeting the quality standards is very non-toxic, with a toxicity rating ($LD_{50}$) of greater than 50 mL/kg.

Although biodiesel that meets the ASTM standards has to be non-toxic, there can be contaminants which tend to crystallize and/or precipitate and fall out of solution as sediment. Sediment formation is particularly a problem when biodiesel is used at lower temperatures. The sediment or precipitates may cause problems such as decreasing fuel flow, clogging fuel lines, clogging filters, etc. Processes are well-known in the art that specifically deal with the removal of these contaminants and sediments in biodiesel in order to produce a higher quality product. Examples for such processes include, but are not limited to, pretreatment of the oil to remove contaminants such as phospholipids and free fatty acids (e.g., degumming, caustic refining and silica adsorbant filtration) and cold filtration. Cold filtration is a process that was developed specifically to remove any particulates and sediments that are present in the biodiesel after production. This process cools the biodiesel and filters out any sediments or precipitates that might form when the fuel is used at a lower temperature. Such a process is well known in the art and is described in US Patent Application Publication No. 2007-0175091. Suitable methods may include cooling the biodiesel to a temperature of less than about 38° C. so that the impurities and contaminants precipitate out as particulates in the biodiesel liquid. Diatomaceous earth or other filtering material may then added to the cooled biodiesel to form a slurry, which may then filtered through a pressure leaf or other type of filter to remove the particulates. The filtered biodiesel may then be run through a polish filter to remove any remaining sediments and diatomaceous earth, so as to produce the final biodiesel product.

Example 9 describes the production of biodiesel using triglyceride oil from *Prototheca moriformis*. The Cold Soak Filterability by the ASTM D6751 A1 method of the biodiesel produced in Example 9 was 120 seconds for a volume of 300 ml. This test involves filtration of 300 ml of B100, chilled to 40° F. for 16 hours, allowed to warm to room temp, and filtered under vacuum using 0.7 micron glass fiber filter with stainless steel support. Oils of the invention can be transesterified to generate biodiesel with a cold soak time of less than 120 seconds, less than 100 seconds, and less than 90 seconds.

Subsequent processes may also be used if the biodiesel will be used in particularly cold temperatures. Such processes include winterization and fractionation. Both processes are designed to improve the cold flow and winter performance of the fuel by lowering the cloud point (the temperature at which the biodiesel starts to crystallize). There are several approaches to winterizing biodiesel. One approach is to blend the biodiesel with petroleum diesel. Another approach is to use additives that can lower the cloud point of biodiesel. Another approach is to remove saturated methyl esters indiscriminately by mixing in additives and allowing for the crystallization of saturates and then filtering out the crystals. Fractionation selectively separates methyl esters into individual components or fractions, allowing for the removal or inclusion of specific methyl esters. Fractionation methods include urea fractionation, solvent fractionation and thermal distillation.

Another valuable fuel provided by the methods of the present invention is renewable diesel, which comprises alkanes, such as C10:0, C12:0, C14:0, C16:0 and C18:0 and thus, are distinguishable from biodiesel. High quality renewable diesel conforms to the ASTM D975 standard. The lipids produced by the methods of the present invention can serve as feedstock to produce renewable diesel. Thus, in another aspect of the present invention, a method for producing renewable diesel is provided. Renewable diesel can be produced by at least three processes: hydrothermal processing (hydrotreating); hydroprocessing; and indirect liquefaction. These processes yield non-ester distillates. During these processes, triacylglycerides produced and isolated as described herein, are converted to alkanes.

In one embodiment, the method for producing renewable diesel comprises (a) cultivating a lipid-containing microorganism using methods disclosed herein (b) lysing the microorganism to produce a lysate, (c) isolating lipid from the lysed microorganism, and (d) deoxygenating and hydrotreating the lipid to produce an alkane, whereby renewable diesel is produced. Lipids suitable for manufacturing renewable diesel can be obtained via extraction from microbial biomass using an organic solvent such as hexane, or via other methods, such as those described in U.S. Pat. No. 5,928,696. Some suitable methods may include mechanical pressing and centrifuging.

In some methods, the microbial lipid is first cracked in conjunction with hydrotreating to reduce carbon chain length and saturate double bonds, respectively. The material is then isomerized, also in conjunction with hydrotreating. The naptha fraction can then be removed through distillation, followed by additional distillation to vaporize and distill components desired in the diesel fuel to meet an ASTM D975 standard while leaving components that are heavier than desired for meeting the D975 standard. Hydrotreating, hydrocracking, deoxygenation and isomerization methods of chemically modifying oils, including triglyceride oils, are well known in the art. See for example European patent applications EP1741768 (A1); EP1741767 (A1); EP1682466 (A1); EP1640437 (A1); EP1681337 (A1); EP1795576 (A1); and U.S. Pat. Nos. 7,238,277; 6,630,066; 6,596,155; 6,977, 322; 7,041,866; 6,217,746; 5,885,440; 6,881,873.

In one embodiment of the method for producing renewable diesel, treating the lipid to produce an alkane is performed by hydrotreating of the lipid composition. In hydrothermal processing, typically, biomass is reacted in water at an elevated temperature and pressure to form oils and residual solids. Conversion temperatures are typically 300° to 660° F., with pressure sufficient to keep the water primarily as a liquid, 100 to 170 standard atmosphere (atm). Reaction times are on the order of 15 to 30 minutes. After the reaction is completed, the organics are separated from the water. Thereby a distillate suitable for diesel is produced.

In some methods of making renewable diesel, the first step of treating a triglyceride is hydroprocessing to saturate double bonds, followed by deoxygenation at elevated temperature in the presence of hydrogen and a catalyst. In some methods, hydrogenation and deoxygenation occur in the same reaction. In other methods deoxygenation occurs before hydrogenation. Isomerization is then optionally performed, also in the presence of hydrogen and a catalyst. Naphtha components are preferably removed through distillation. For examples, see U.S. Pat. Nos. 5,475,160 (hydrogenation of triglycerides); 5,091,116 (deoxygenation, hydrogenation and gas removal); 6,391,815 (hydrogenation); and 5,888,947 (isomerization).

One suitable method for the hydrogenation of triglycerides includes preparing an aqueous solution of copper, zinc, magnesium and lanthanum salts and another solution of alkali metal or preferably, ammonium carbonate. The two solutions may be heated to a temperature of about 20° C. to about 85° C. and metered together into a precipitation container at rates such that the pH in the precipitation container is maintained between 5.5 and 7.5 in order to form a catalyst. Additional water may be used either initially in the precipitation container or added concurrently with the salt solution and precipitation solution. The resulting precipitate may then be thoroughly washed, dried, calcined at about 300° C. and activated in hydrogen at temperatures ranging from about 100° C. to about 400° C. One or more triglycerides may then be contacted and reacted with hydrogen in the presence of the above-described catalyst in a reactor. The reactor may be a trickle bed reactor, fixed bed gas-solid reactor, packed bubble column reactor, continuously stirred tank reactor, a slurry phase reactor, or any other suitable reactor type known in the art. The process may be carried out either batchwise or in continuous fashion. Reaction temperatures are typically in the range of from about 170° C. to about 250° C. while reaction pressures are typically in the range of from about 300 psig to about 2000 psig. Moreover, the molar ratio of hydrogen to triglyceride in the process of the present invention is typically in the range of from about 20:1 to about 700:1. The process is typically carried out at a weight hourly space velocity (WHSV) in the range of from about 0.1 $hr^{-1}$ to about 5 $hr^{-1}$. One skilled in the art will recognize that the time period required for reaction will vary according to the temperature used, the molar ratio of hydrogen to triglyceride, and the partial pressure of hydrogen. The products produced by the such hydrogenation processes include fatty alcohols, glycerol, traces of paraffins and unreacted triglycerides. These products are typically separated by conventional means such as, for example, distillation, extraction, filtration, crystallization, and the like.

Petroleum refiners use hydroprocessing to remove impurities by treating feeds with hydrogen. Hydroprocessing conversion temperatures are typically 300° to 700° F. Pressures are typically 40 to 100 atm. The reaction times are typically on the order of 10 to 60 minutes. Solid catalysts are employed to increase certain reaction rates, improve selectivity for certain products, and optimize hydrogen consumption.

Suitable methods for the deoxygenation of an oil includes heating an oil to a temperature in the range of from about 350° F. to about 550° F. and continuously contacting the heated oil with nitrogen under at least pressure ranging from about atmospheric to above for at least about 5 minutes.

Suitable methods for isomerization include using alkali isomerization and other oil isomerization known in the art.

Hydrotreating and hydroprocessing ultimately lead to a reduction in the molecular weight of the triglyceride feed. The triglyceride molecule is reduced to four hydrocarbon molecules under hydroprocessing conditions: a propane molecule and three heavier hydrocarbon molecules, typically in the C8 to C18 range.

Thus, in one embodiment, the product of one or more chemical reaction(s) performed on lipid compositions of the invention is an alkane mixture that comprises ASTM D975 renewable diesel. Production of hydrocarbons by microorganisms is reviewed by Metzger et al. Appl Microbiol Biotechnol (2005) 66: 486-496 and A Look Back at the U.S. Department of Energy's Aquatic Species Program: Biodiesel from Algae, NREL/TP-580-24190, John Sheehan, Terri Dunahay, John Benemann and Paul Roessler (1998).

The distillation properties of a diesel fuel is described in terms of T10-T90 (temperature at 10% and 90%, respectively, volume distilled). Renewable diesel was produced from *Prototheca moriformis* triglyceride oil and is described in Example 9. The T10-T90 of the material produced in Example 9 was 57.9° C. Methods of hydrotreating, isomerization, and other covalent modification of oils disclosed herein, as well as methods of distillation and fractionation (such as cold filtration) disclosed herein, can be employed to generate renewable diesel compositions with other T10-T90 ranges, such as 20, 25, 30, 35, 40, 45, 50, 60 and 65° C. using triglyceride oils produced according to the methods disclosed herein.

The T10 of the material produced in Example 9 was 242.1° C. Methods of hydrotreating, isomerization, and other covalent modification of oils disclosed herein, as well as methods of distillation and fractionation (such as cold filtration) disclosed herein, can be employed to generate renewable diesel compositions with other T10 values, such as T10 between 180 and 295, between 190 and 270, between 210 and 250, between 225 and 245, and at least 290.

The T90 of the material produced in Example 9 was 300° C. Methods of hydrotreating, isomerization, and other covalent modification of oils disclosed herein, as well as methods of distillation and fractionation (such as cold filtration) disclosed herein can be employed to generate renewable diesel compositions with other T90 values, such as T90 between 280 and 380, between 290 and 360, between 300 and 350, between 310 and 340, and at least 290.

The FBP of the material produced in Example 9 was 300° C. Methods of hydrotreating, isomerization, and other covalent modification of oils disclosed herein, as well as methods of distillation and fractionation (such as cold filtration) disclosed herein, can be employed to generate renewable diesel compositions with other FBP values, such as FBP between 290 and 400, between 300 and 385, between 310 and 370, between 315 and 360, and at least 300.

Other oils provided by the methods and compositions of the invention can be subjected to combinations of hydrotreating, isomerization, and other covalent modification including oils with lipid profiles including (a) at least 4% C8-C14; (b) at least 0.3% C8; (c) at least 2% C10; (d) at least 2% C12; and (3) at least 30% C8-C14.

A traditional ultra-low sulfur diesel can be produced from any form of biomass by a two-step process. First, the biomass is converted to a syngas, a gaseous mixture rich in hydrogen and carbon monoxide. Then, the syngas is catalytically converted to liquids. Typically, the production of liquids is accomplished using Fischer-Tropsch (FT) synthesis. This technology applies to coal, natural gas, and heavy oils. Thus, in yet another preferred embodiment of the method for producing renewable diesel, treating the lipid composition to produce an alkane is performed by indirect liquefaction of the lipid composition.

The present invention also provides methods to produce jet fuel. Jet fuel is clear to straw colored. The most common fuel is an unleaded/paraffin oil-based fuel classified as Aeroplane A-1, which is produced to an internationally standardized set of specifications. Jet fuel is a mixture of a large number of different hydrocarbons, possibly as many as a thousand or more. The range of their sizes (molecular weights or carbon numbers) is restricted by the requirements for the product, for example, freezing point or smoke point. Kerosone-type Aeroplane fuel (including Jet A and Jet A-1) has a carbon number distribution between about 8 and 16 carbon numbers. Wide-cut or naphta-type Aeroplane fuel (including Jet B) typically has a carbon number distribution between about 5 and 15 carbons.

Both Aeroplanes (Jet A and Jet B) may contain a number of additives. Useful additives include, but are not limited to, antioxidants, antistatic agents, corrosion inhibitors, and fuel system icing inhibitor (FSII) agents. Antioxidants prevent gumming and usually, are based on alkylated phenols, for example, AO-30, AO-31, or AO-37. Antistatic agents dissipate static electricity and prevent sparking. Stadis 450 with dinonylnaphthylsulfonic acid (DINNSA) as the active ingredient, is an example. Corrosion inhibitors, e.g., DCI-4A is used for civilian and military fuels and DCI-6A is used for military fuels. FSII agents, include, e.g., Di-EGME.

In one embodiment of the invention, a jet fuel is produced by blending algal fuels with existing jet fuel. The lipids produced by the methods of the present invention can serve as feedstock to produce jet fuel. Thus, in another aspect of the present invention, a method for producing jet fuel is provided. Herewith two methods for producing jet fuel from the lipids produced by the methods of the present invention are provided: fluid catalytic cracking (FCC); and hydrodeoxygenation (HDO).

Fluid Catalytic Cracking (FCC) is one method which is used to produce olefins, especially propylene from heavy crude fractions. The lipids produced by the method of the present invention can be converted to olefins. The process involves flowing the lipids produced through an FCC zone and collecting a product stream comprised of olefins, which is useful as a jet fuel. The lipids produced are contacted with a cracking catalyst at cracking conditions to provide a product stream comprising olefins and hydrocarbons useful as jet fuel.

In one embodiment, the method for producing jet fuel comprises (a) cultivating a lipid-containing microorganism using methods disclosed herein, (b) lysing the lipid-containing microorganism to produce a lysate, (c) isolating lipid from the lysate, and (d) treating the lipid composition, whereby jet fuel is produced. In one embodiment of the method for producing a jet fuel, the lipid composition can be flowed through a fluid catalytic cracking zone, which, in one embodiment, may comprise contacting the lipid composition with a cracking catalyst at cracking conditions to provide a product stream comprising $C_2$-$C_5$ olefins.

In certain embodiments of this method, it may be desirable to remove any contaminants that may be present in the lipid composition. Thus, prior to flowing the lipid composition through a fluid catalytic cracking zone, the lipid composition is pretreated. Pretreatment may involve contacting the lipid composition with an ion-exchange resin. The ion exchange resin is an acidic ion exchange resin, such as Amberlyst™-15 and can be used as a bed in a reactor through which the lipid composition is flowed, either upflow or downflow. Other pretreatments may include mild acid washes by contacting the lipid composition with an acid, such as sulfuric, acetic, nitric, or hydrochloric acid. Contacting is done with a dilute acid solution usually at ambient temperature and atmospheric pressure.

The lipid composition, optionally pretreated, is flowed to an FCC zone where the hydrocarbonaceous components are cracked to olefins. Catalytic cracking is accomplished by contacting the lipid composition in a reaction zone with a catalyst composed of finely divided particulate material. The reaction is catalytic cracking, as opposed to hydrocracking, and is carried out in the absence of added hydrogen or the consumption of hydrogen. As the cracking reaction proceeds, substantial amounts of coke are deposited on the catalyst. The catalyst is regenerated at high temperatures by burning coke from the catalyst in a regeneration zone. Coke-containing catalyst, referred to herein as "coked catalyst", is continually transported from the reaction zone to the regeneration zone to be regenerated and replaced by essentially coke-free regenerated catalyst from the regeneration zone. Fluidization of the catalyst particles by various gaseous streams allows the transport of catalyst between the reaction zone and regeneration zone. Methods for cracking hydrocarbons, such as those of the lipid composition described herein, in a fluidized stream of catalyst, transporting catalyst between reaction and regeneration zones, and combusting coke in the regenerator are well known by those skilled in the art of FCC processes. Exemplary FCC applications and catalysts useful for cracking the lipid composition to produce $C_2$-$C_5$ olefins are described in U.S. Pat. Nos. 6,538,169, 7,288,685, which are incorporated in their entirety by reference.

Suitable FCC catalysts generally comprise at least two components that may or may not be on the same matrix. In some embodiments, both two components may be circulated throughout the entire reaction vessel. The first component generally includes any of the well-known catalysts that are used in the art of fluidized catalytic cracking, such as an active amorphous clay-type catalyst and/or a high activity, crystalline molecular sieve. Molecular sieve catalysts may be preferred over amorphous catalysts because of their much-improved selectivity to desired products. IN some preferred embodiments, zeolites may be used as the molecular sieve in the FCC processes. Preferably, the first catalyst component comprises a large pore zeolite, such as an Y-type zeolite, an active alumina material, a binder material, comprising either silica or alumina and an inert filler such as kaolin.

In one embodiment, cracking the lipid composition of the present invention, takes place in the riser section or, alternatively, the lift section, of the FCC zone. The lipid composition is introduced into the riser by a nozzle resulting in the rapid vaporization of the lipid composition. Before contacting the catalyst, the lipid composition will ordinarily have a temperature of about 149° C. to about 316° C. (300° F. to 600° F.). The catalyst is flowed from a blending vessel to the riser where it contacts the lipid composition for a time of abort 2 seconds or less.

The blended catalyst and reacted lipid composition vapors are then discharged from the top of the riser through an outlet and separated into a cracked product vapor stream including olefins and a collection of catalyst particles covered with substantial quantities of coke and generally referred to as "coked catalyst." In an effort to minimize the contact time of the lipid composition and the catalyst which may promote further conversion of desired products to undesirable other products, any arrangement of separators such as a swirl arm arrangement can be used to remove coked catalyst from the product stream quickly. The separator, e.g. swirl arm separator, is located in an upper portion of a chamber with a stripping zone situated in the lower portion of the chamber. Catalyst separated by the swirl arm arrangement drops down into the stripping zone. The cracked product vapor stream comprising cracked hydrocarbons including light olefins and some catalyst exit the chamber via a conduit which is in communication with cyclones. The cyclones remove remaining catalyst particles from the product vapor stream to reduce particle concentrations to very low levels. The product vapor stream then exits the top of the separating vessel. Catalyst separated by the cyclones is returned to the separating vessel and then to the stripping zone. The stripping zone removes adsorbed hydrocarbons from the surface of the catalyst by counter-current contact with steam.

Low hydrocarbon partial pressure operates to favor the production of light olefins. Accordingly, the riser pressure is set at about 172 to 241 kPa (25 to 35 psia) with a hydrocarbon partial pressure of about 35 to 172 kPa (5 to 25 psia), with a preferred hydrocarbon partial pressure of about 69 to 138 kPa (10 to 20 psia). This relatively low partial pressure for hydrocarbon is achieved by using steam as a diluent to the extent that the diluent is 10 to 55 wt-% of lipid composition and preferably about 15 wt-% of lipid composition. Other diluents such as dry gas can be used to reach equivalent hydrocarbon partial pressures.

The temperature of the cracked stream at the riser outlet will be about 510° C. to 621° C. (950° F. to 1150° F.). However, riser outlet temperatures above 566° C. (1050° F.) make more dry gas and more olefins. Whereas, riser outlet temperatures below 566° C. (1050° F.) make less ethylene and propylene. Accordingly, it is preferred to run the FCC process at a preferred temperature of about 566° C. to about 630° C., preferred pressure of about 138 kPa to about 240 kPa (20 to 35 psia). Another condition for the process is the catalyst to lipid composition ratio which can vary from about 5 to about 20 and preferably from about 10 to about 15.

In one embodiment of the method for producing a jet fuel, the lipid composition is introduced into the lift section of an FCC reactor. The temperature in the lift section will be very hot and range from about 700° C. (1292° F.) to about 760° C. (1400° F.) with a catalyst to lipid composition ratio of about 100 to about 150. It is anticipated that introducing the lipid composition into the lift section will produce considerable amounts of propylene and ethylene.

In another embodiment of the method for producing a jet fuel using the lipid composition or the lipids produced as described herein, the structure of the lipid composition or the lipids is broken by a process referred to as hydrodeoxygenation (HDO). HDO means removal of oxygen by means of hydrogen, that is, oxygen is removed while breaking the structure of the material. Olefinic double bonds are hydrogenated and any sulphur and nitrogen compounds are removed. Sulphur removal is called hydrodesulphurization (HDS). Pretreatment and purity of the raw materials (lipid composition or the lipids) contribute to the service life of the catalyst.

Generally in the HDO/HDS step, hydrogen is mixed with the feed stock (lipid composition or the lipids) and then the mixture is passed through a catalyst bed as a co-current flow, either as a single phase or a two phase feed stock. After the HDO/MDS step, the product fraction is separated and passed to a separate isomerzation reactor. An isomerization reactor for biological starting material is described in the literature (FI 100 248) as a co-current reactor.

The process for producing a fuel by hydrogenating a hydrocarbon feed, e.g., the lipid composition or the lipids herein, can also be performed by passing the lipid composition or the lipids as a co-current flow with hydrogen gas through a first hydrogenation zone, and thereafter the hydrocarbon effluent is further hydrogenated in a second hydrogenation zone by passing hydrogen gas to the second hydrogenation zone as a counter-current flow relative to the hydrocarbon effluent. Exemplary HDO applications and catalysts useful for cracking the lipid composition to produce $C_2$-$C_5$ olefins are described in U.S. Pat. No. 7,232,935, which is incorporated in its entirety by reference.

Typically, in the hydrodeoxygenation step, the structure of the biological component, such as the lipid composition or lipids herein, is decomposed, oxygen, nitrogen, phosphorus and sulphur compounds, and light hydrocarbons as gas are removed, and the olefinic bonds are hydrogenated. In the second step of the process, i.e. in the so-called isomerization step, isomerization is carried out for branching the hydrocarbon chain and improving the performance of the paraffin at low temperatures.

In the first step, i.e. HDO step, of the cracking process, hydrogen gas and the lipid composition or lipids herein which are to be hydrogenated are passed to a HDO catalyst bed system either as co-current or counter-current flows, said catalyst bed system comprising one or more catalyst bed(s), preferably 1-3 catalyst beds. The HDO step is typically operated in a co-current manner. In case of a HDO catalyst bed system comprising two or more catalyst beds, one or more of the beds may be operated using the counter-current flow principle. In the HDO step, the pressure varies between 20 and 150 bar, preferably between 50 and 100 bar, and the temperature varies between 200 and 500° C., preferably in the range of 300-400° C. In the HDO step, known hydrogenation catalysts containing metals from Group VII and/or VIB of the Periodic System may be used. Preferably, the hydrogenation catalysts are supported Pd, Pt, Ni, NiMo or a CoMo catalysts, the support being alumina and/or silica. Typically, NiMo/$Al_2O_3$ and CoMo/$Al_2O_3$ catalysts are used.

Prior to the HDO step, the lipid composition or lipids herein may optionally be treated by prehydrogenation under milder conditions thus avoiding side reactions of the double bonds. Such prehydrogenation is carried out in the presence of a prehydrogenation catalyst at temperatures of 50-400° C. and at hydrogen pressures of 1-200 bar, preferably at a temperature between 150 and 250° C. and at a hydrogen pressure between 10 and 100 bar. The catalyst may contain metals from Group VIII and/or VIB of the Periodic System. Preferably, the prehydrogenation catalyst is a supported Pd, Pt, Ni, NiMo or a CoMo catalyst, the support being alumina and/or silica.

A gaseous stream from the HDO step containing hydrogen is cooled and then carbon monoxide, carbon dioxide, nitrogen, phosphorus and sulphur compounds, gaseous light hydrocarbons and other impurities are removed therefrom. After compressing, the purified hydrogen or recycled hydrogen is returned back to the first catalyst bed and/or between the catalyst beds to make up for the withdrawn gas stream. Water is removed from the condensed liquid. The liquid is passed to the first catalyst bed or between the catalyst beds.

After the HDO step, the product is subjected to an isomerization step. It is substantial for the process that the impurities are removed as completely as possible before the hydrocarbons are contacted with the isomerization catalyst. The isomerization step comprises an optional stripping step, wherein the reaction product from the HDO step may be purified by stripping with water vapour or a suitable gas such as light hydrocarbon, nitrogen or hydrogen. The optional stripping step is carried out in counter-current manner in a unit upstream of the isomerization catalyst, wherein the gas and liquid are contacted with each other, or before the actual isomerization reactor in a separate stripping unit utilizing counter-current principle.

After the stripping step the hydrogen gas and the hydrogenated lipid composition or lipids herein, and optionally an n-paraffin mixture, are passed to a reactive isomerization unit comprising one or several catalyst bed(s). The catalyst beds of the isomerization step may operate either in co-current or counter-current manner.

It is important for the process that the counter-current flow principle is applied in the isomerization step. In the isomerization step this is done by carrying out either the optional stripping step or the isomerization reaction step or both in counter-current manner. In the isomerization step, the pressure varies in the range of 20-150 bar, preferably in the range of 20-100 bar, the temperature being between 200 and 500° C., preferably between 300 and 400° C. In the isomerization step, isomerization catalysts known in the art may be used. Suitable isomerization catalysts contain molecular sieve and/or a metal from Group VII and/or a carrier. Preferably, the isomerization catalyst contains SAPO-11 or SAPO41 or ZSM-22 or ZSM-23 or ferrierite and Pt, Pd or Ni and $Al_2O_3$ or $SiO_2$. Typical isomerization catalysts are, for example, Pt/SAPO-11/$Al_2O_3$, Pt/ZSM-22/$Al_2O_3$, Pt/ZSM-23/$Al_2O_3$ and Pt/SAPO-11/$SiO_2$. The isomerization step and the HDO step may be carried out in the same pressure vessel or in separate pressure vessels. Optional prehydrogenation may be carried out in a separate pressure vessel or in the same pressure vessel as the HDO and isomerization steps.

Thus, in one embodiment, the product of one or more chemical reactions is an alkane mixture that comprises HRJ-5. In another embodiment, the product of the one or more chemical reactions is an alkane mixture that comprises ASTM D1655 jet fuel. In some embodiments, the composition conforming to the specification of ASTM 1655 jet fuel has a sulfur content that is less than 10 ppm. In other embodiments, the composition conforming to the specification of ASTM 1655 jet fuel has a T10 value of the distillation curve of less than 205° C. In another embodiment, the composition conforming to the specification of ASTM 1655 jet fuel has a final boiling point (FBP) of less than 300° C. In another embodiment, the composition conforming to the specification of ASTM 1655 jet fuel has a flash point of at least 38° C. In another embodiment, the composition conforming to the specification of ASTM 1655 jet fuel has a density between 775 K/$m^3$ and 840 K/$m^3$. In yet another embodiment, the composition conforming to the specification of ASTM 1655 jet fuel has a freezing point that is below −47° C. In another embodiment, the composition conforming to the specification of ASTM 1655 jet fuel has a net Heat of Combustion that is at least 42.8 MJ/K. In another embodiment, the composition conforming to the specification of ASTM 1655 jet fuel has a hydrogen content that is at least 13.4 mass %. In another embodiment, the composition conforming to the specification of ASTM 1655 jet fuel has a thermal stability, as tested by quantitative gravimetric JFTOT at 260° C., that is below 3 mm of Hg. In another embodiment, the composition conforming to the specification of ASTM 1655 jet fuel has an existent gum that is below 7 mg/dl.

Thus, the present invention discloses a variety of methods in which chemical modification of microalgal lipid is undertaken to yield products useful in a variety of industrial and other applications. Examples of processes for modifying oil produced by the methods disclosed herein include, but are not limited to, hydrolysis of the oil, hydroprocessing of the oil, and esterification of the oil. Other chemical modification of microalgal lipid include, without limitation, epoxidation, oxidation, hydrolysis, sulfations, sulfonation, ethoxylation, propoxylation, amidation, and saponification. The modification of the microalgal oil produces basic oleochemicals that can be further modified into selected derivative oleochemicals for a desired function. In a manner similar to that described above with reference to fuel producing processes, these chemical modifications can also be performed on oils generated from the microbial cultures described herein. Examples of basic oleochemicals include, but are not limited to, soaps, fatty acids, fatty esters, fatty alcohols, fatty nitrogen compounds, fatty acid methyl esters, and glycerol. Examples of derivative oleochemicals include, but are not limited to, fatty nitriles, esters, dimer acids, quats, surfactants, fatty alkanolamides, fatty alcohol sulfates, resins, emulsifiers, fatty alcohols, olefins, drilling muds, polyols, polyurethanes, polyacrylates, rubber, candles, cosmetics, metallic soaps, soaps, alpha-sulphonated methyl esters, fatty alcohol sulfates, fatty alcohol ethoxylates, fatty alcohol ether sulfates, imidazolines, surfactants, detergents, esters, quats, ozonolysis products, fatty amines, fatty alkanolamides, ethoxysulfates, monoglycerides, diglycerides, triglycerides (including medium chain triglycerides), lubricants, hydraulic fluids, greases, dielectric fluids, mold release agents, metal working fluids, heat transfer fluids, other functional fluids, industrial chemicals (e.g., cleaners, textile processing aids, plasticizers, stabilizers, additives), surface coatings, paints and lacquers, electrical wiring insulation, and higher alkanes.

Hydrolysis of the fatty acid constituents from the glycerolipids produced by the methods of the invention yields free fatty acids that can be derivatized to produce other useful chemicals. Hydrolysis occurs in the presence of water and a catalyst which may be either an acid or a base. The liberated free fatty acids can be derivatized to yield a variety of products, as reported in the following: U.S. Pat. Nos. 5,304,664 (Highly sulfated fatty acids); 7,262,158 (Cleansing compositions); 7,115,173 (Fabric softener compositions); 6,342,208 (Emulsions for treating skin); 7,264,886 (Water repellant compositions); 6,924,333 (Paint additives); 6,596,768 (Lipid-enriched ruminant feedstock); and 6,380,410 (Surfactants for detergents and cleaners).

With regard to hydrolysis, in one embodiment of the invention, a triglyceride oil is optionally first hydrolyzed in a liquid medium such as water or sodium hydroxide so as to obtain glycerol and soaps. There are various suitable triglyceride hydrolysis methods, including, but not limited to, saponification, acid hydrolysis, alkaline hydrolysis, enzymatic hydrolysis (referred herein as splitting), and hydrolysis using hot-compressed water. One skilled in the art will recognize that a triglyceride oil need not be hydrolyzed in order to produce an oleochemical; rather, the oil may be converted directly to the desired oleochemical by other known process. For example, the triglyceride oil may be directly converted to a methyl ester fatty acid through esterification.

In some embodiments, catalytic hydrolysis of the oil produced by methods disclosed herein occurs by splitting the oil into glycerol and fatty acids. As discussed above, the fatty acids may then be further processed through several other modifications to obtained derivative oleochemicals. For example, in one embodiment the fatty acids may undergo an amination reaction to produce fatty nitrogen compounds. In another embodiment, the fatty acids may undergo ozonolysis to produce mono- and dibasic-acids.

In other embodiments hydrolysis may occur via the, splitting of oils produced herein to create oleochemicals. In some preferred embodiments of the invention, a triglyceride oil may be split before other processes is performed. One skilled in the art will recognize that there are many suitable triglyceride splitting methods, including, but not limited to, enzymatic splitting and pressure splitting.

Generally, enzymatic oil splitting methods use enzymes, lipases, as biocatalysts acting on a water/oil mixture. Enzymatic splitting then splits the oil or fat, respectively, is into glycerol and free fatty acids. The glycerol may then migrates into the water phase whereas the organic phase enriches with free fatty acids.

The enzymatic splitting reactions generally take place at the phase boundary between organic and aqueous phase, where the enzyme is present only at the phase boundary. Triglycerides that meet the phase boundary then contribute to or participate in the splitting reaction. As the reaction proceeds, the occupation density or concentration of fatty acids still chemically bonded as glycerides, in comparison to free fatty acids, decreases at the phase boundary so that the reaction is slowed down. In certain embodiments, enzymatic splitting may occur at room temperature. One of ordinary skill in the art would know the suitable conditions for splitting oil into the desired fatty acids.

By way of example, the reaction speed can be accelerated by increasing the interface boundary surface. Once the reaction is complete, free fatty acids are then separated from the organic phase freed from enzyme, and the residue which still contains fatty acids chemically bonded as glycerides is fed back or recycled and mixed with fresh oil or fat to be subjected to splitting. In this manner, recycled glycerides are then subjected to a further enzymatic splitting process. In some embodiments, the free fatty acids are extracted from an oil or fat partially split in such a manner. In that way, if the chemically bound fatty acids (triglycerides) are returned or fed back into the splitting process, the enzyme consumption can be drastically reduced.

The splitting degree is determined as the ratio of the measured acid value divided by the theoretically possible acid value which can be computed for a given oil or fat. Preferably, the acid value is measured by means of titration according to standard common methods. Alternatively, the density of the aqueous glycerol phase can be taken as a measure for the splitting degree.

In one embodiment, the slitting process as described herein is also suitable for splitting the mono-, di- and triglyceride that are contained in the so-called soap-stock from the alkali refining processes of the produced oils. In this manner, the soap-stock can be quantitatively converted without prior saponification of the neutral oils into the fatty acids. For this purpose, the fatty acids being chemically bonded in the soaps are released, preferably before splitting, through an addition of acid. In certain embodiments, a buffer solution is used in addition to water and enzyme for the splitting process.

In one embodiment, oils produced in accordance with the methods of the invention can also be subjected to saponification as a method of hydrolysis Animal and plant oils are typically made of triacylglycerols (TAGs), which are esters of fatty acids with the trihydric alcohol, glycerol. In an alkaline hydrolysis reaction, the glycerol in a TAG is removed, leaving three carboxylic acid anions that can associate with alkali metal cations such as sodium or potassium to produce fatty acid salts. In this scheme, the carboxylic acid constituents are cleaved from the glycerol moiety and replaced with hydroxyl groups. The quantity of base (e.g., KOH) that is used in the reaction is determined by the desired degree of saponification. If the objective is, for example, to produce a soap product that comprises some of the oils originally present in the TAG composition, an amount of base insufficient to convert all of the TAGs to fatty acid salts is introduced into the reaction mixture. Normally, this reaction is performed in an aqueous solution and proceeds slowly, but may be expedited by the addition of heat. Precipitation of the fatty acid salts can be facilitated by addition of salts, such as water-soluble alkali metal halides (e.g., NaCl or KCl), to the reaction mixture. Preferably, the base is an alkali metal hydroxide, such as NaOH or KOH. Alternatively, other bases, such as alkanolamines, including for example triethanolamine and aminomethylpropanol, can be used in the reaction scheme. In some cases, these alternatives may be preferred to produce a clear soap product. In one embodiment the lipid composition subjected to saponification is a tallow mimetic (i.e., lipid composition similar to that of tallow) produced as described herein, or a blend of a tallow mimetic with another triglyceride oil.

In some methods, the first step of chemical modification may be hydroprocessing to saturate double bonds, followed by deoxygenation at elevated temperature in the presence of hydrogen and a catalyst. In other methods, hydrogenation and deoxygenation may occur in the same reaction. In still other methods deoxygenation occurs before hydrogenation. Isomerization may then be optionally performed, also in the presence of hydrogen and a catalyst. Finally, gases and naphtha components can be removed if desired. For example, see U.S. Pat. Nos. 5,475,160 (hydrogenation of triglycerides);

5,091,116 (deoxygenation, hydrogenation and gas removal); 6,391,815 (hydrogenation); and 5,888,947 (isomerization).

In some embodiments of the invention, the triglyceride oils are partially or completely deoxygenated. The deoxygenation reactions form desired products, including, but not limited to, fatty acids, fatty alcohols, polyols, ketones, and aldehydes. In general, without being limited by any particular theory, the deoxygenation reactions involve a combination of various different reaction pathways, including without limitation: hydrogenolysis, hydrogenation, consecutive hydrogenation-hydrogenolysis, consecutive hydrogenolysis-hydrogenation, and combined hydrogenation-hydrogenolysis reactions, resulting in at least the partial removal of oxygen from the fatty acid or fatty acid ester to produce reaction products, such as fatty alcohols, that can be easily converted to the desired chemicals by further processing. For example, in one embodiment, a fatty alcohol may be converted to olefins through FCC reaction or to higher alkanes through a condensation reaction.

One such chemical modification is hydrogenation, which is the addition of hydrogen to double bonds in the fatty acid constituents of glycerolipids or of free fatty acids. The hydrogenation process permits the transformation of liquid oils into semi-solid or solid fats, which may be more suitable for specific applications.

Hydrogenation of oil produced by the methods described herein can be performed in conjunction with one or more of the methods and/or materials provided herein, as reported in the following: U.S. Pat. Nos. 7,288,278 (Food additives or medicaments); 5,346,724 (Lubrication products); 5,475,160 (Fatty alcohols); 5,091,116 (Edible oils); 6,808,737 (Structural fats for margarine and spreads); 5,298,637 (Reduced-calorie fat substitutes); 6,391,815 (Hydrogenation catalyst and sulfur adsorbent); 5,233,099 and 5,233,100 (Fatty alcohols); 4,584,139 (Hydrogenation catalysts); 6,057,375 (Foam suppressing agents); and 7,118,773 (Edible emulsion spreads).

One skilled in the art will recognize that various processes may be used to hydrogenate carbohydrates. One suitable method includes contacting the carbohydrate with hydrogen or hydrogen mixed with a suitable gas and a catalyst under conditions sufficient in a hydrogenation reactor to form a hydrogenated product. The hydrogenation catalyst generally can include Cu, Re, Ni, Fe, Co, Ru, Pd, Rh, Pt, Os, Ir, and alloys or any combination thereof, either alone or with promoters such as W, Mo, Au, Ag, Cr, Zn, Mn, Sn, B, P, Bi, and alloys or any combination thereof. Other effective hydrogenation catalyst materials include either supported nickel or ruthenium modified with rhenium. In an embodiment, the hydrogenation catalyst also includes any one of the supports, depending on the desired functionality of the catalyst. The hydrogenation catalysts may be prepared by methods known to those of ordinary skill in the art.

In some embodiments the hydrogenation catalyst includes a supported Group VIII metal catalyst and a metal sponge material (e.g., a sponge nickel catalyst). Raney nickel provides an example of an activated sponge nickel catalyst suitable for use in this invention. In other embodiment, the hydrogenation reaction in the invention is performed using a catalyst comprising a nickel-rhenium catalyst or a tungsten-modified nickel catalyst. One example of a suitable catalyst for the hydrogenation reaction of the invention is a carbon-supported nickel-rhenium catalyst.

In an embodiment, a suitable Raney nickel catalyst may be prepared by treating an alloy of approximately equal amounts by weight of nickel and aluminum with an aqueous alkali solution, e.g., containing about 25 weight % of sodium hydroxide. The aluminum is selectively dissolved by the aqueous alkali solution resulting in a sponge shaped material comprising mostly nickel with minor amounts of aluminum. The initial alloy includes promoter metals (i.e., molybdenum or chromium) in the amount such that about 1 to 2 weight % remains in the formed sponge nickel catalyst. In another embodiment, the hydrogenation catalyst is prepared using a solution of ruthenium(III) nitrosyl nitrate, ruthenium (III) chloride in water to impregnate a suitable support material. The solution is then dried to form a solid having a water content of less than about 1% by weight. The solid may then be reduced at atmospheric pressure in a hydrogen stream at 300° C. (uncalcined) or 400° C. (calcined) in a rotary ball furnace for 4 hours. After cooling and rendering the catalyst inert with nitrogen, 5% by volume of oxygen in nitrogen is passed over the catalyst for 2 hours.

In certain embodiments, the catalyst described includes a catalyst support. The catalyst support stabilizes and supports the catalyst. The type of catalyst support used depends on the chosen catalyst and the reaction conditions. Suitable supports for the invention include, but are not limited to, carbon, silica, silica-alumina, zirconia, titania, ceria, vanadia, nitride, boron nitride, heteropolyacids, hydroxyapatite, zinc oxide, chromia, zeolites, carbon nanotubes, carbon fullerene and any combination thereof.

The catalysts used in this invention can be prepared using conventional methods known to those in the art. Suitable methods may include, but are not limited to, incipient wetting, evaporative impregnation, chemical vapor deposition, wash-coating, magnetron sputtering techniques, and the like.

The conditions for which to carry out the hydrogenation reaction will vary based on the type of starting material and the desired products. One of ordinary skill in the art, with the benefit of this disclosure, will recognize the appropriate reaction conditions. In general, the hydrogenation reaction is conducted at temperatures of 80° C. to 250° C., and preferably at 90° C. to 200° C., and most preferably at 100° C. to 150° C. In some embodiments, the hydrogenation reaction is conducted at pressures from 500 KPa to 14000 KPa.

The hydrogen used in the hydrogenolysis reaction of the current invention may include external hydrogen, recycled hydrogen, in situ generated hydrogen, and any combination thereof. As used herein, the term "external hydrogen" refers to hydrogen that does not originate from the biomass reaction itself, but rather is added to the system from another source.

In some embodiments of the invention, it is desirable to convert the starting carbohydrate to a smaller molecule that will be more readily converted to desired higher hydrocarbons. One suitable method for this conversion is through a hydrogenolysis reaction. Various processes are known for performing hydrogenolysis of carbohydrates. One suitable method includes contacting a carbohydrate with hydrogen or hydrogen mixed with a suitable gas and a hydrogenolysis catalyst in a hydrogenolysis reactor under conditions sufficient to form a reaction product comprising smaller molecules or polyols. Here, the term "smaller molecules or polyols" includes any molecule that has a smaller molecular weight, which can include a lesser number of carbon atoms or oxygen atoms than the starting carbohydrate. In an embodiment, the reaction products include smaller molecules that include polyols and alcohols. Someone of ordinary skill in the art would be able to choose the appropriate method by which to carry out the hydrogenolysis reaction.

In some embodiments, a 5 and/or 6 carbon sugar or sugar alcohol may be converted to propylene glycol, ethylene glycol, and glycerol using a hydrogenolysis catalyst. The hydrogenolysis catalyst may include Cr, Mo, W, Re, Mn, Cu, Cd, Fe, Co, Ni, Pt, Pd, Rh, Ru, Ir, Os, and alloys or any combination thereof, either alone or with promoters such as Au, Ag, Cr, Zn, Mn, Sn, Bi, B, O, and alloys or any combination thereof. The hydrogenolysis catalyst may also include a carbonaceous pyropolymer catalyst containing transition metals (e.g., chromium, molybdemum, tungsten, rhenium, manganese, copper, cadmium) or Group VIII metals (e.g., iron, cobalt, nickel, platinum, palladium, rhodium, ruthenium, iridium, and osmium). In certain embodiments, the hydrogenolysis catalyst may include any of the above metals combined with an alkaline earth metal oxide or adhered to a catalytically active support. In certain embodiments, the catalyst described in the hydrogenolysis reaction may include a catalyst support as described above for the hydrogenation reaction.

The conditions for which to carry out the hydrogenolysis reaction will vary based on the type of starting material and the desired products. One of ordinary skill in the art, with the benefit of this disclosure, will recognize the appropriate conditions to use to carry out the reaction. In general, they hydrogenolysis reaction is conducted at temperatures of 110° C. to 300° C., and preferably at 170° C. to 220° C., and most preferably at 200° C. to 225° C. In some embodiments, the hydrogenolysis reaction is conducted under basic conditions, preferably at a pH of 8 to 13, and even more preferably at a pH of 10 to 12. In some embodiments, the hydrogenolysis reaction is conducted at pressures in a range between 60 KPa and 16500 KPa, and preferably in a range between 1700 KPa and 14000 KPa, and even more preferably between 4800 KPa and 11000 KPa.

The hydrogen used in the hydrogenolysis reaction of the current invention can include external hydrogen, recycled hydrogen, in situ generated hydrogen, and any combination thereof.

In some embodiments, the reaction products discussed above may be converted into higher hydrocarbons through a condensation reaction in a condensation reactor. In such embodiments, condensation of the reaction products occurs in the presence of a catalyst capable of forming higher hydrocarbons. While not intending to be limited by theory, it is believed that the production of higher hydrocarbons proceeds through a stepwise addition reaction including the formation of carbon-carbon, or carbon-oxygen bond. The resulting reaction products include any number of compounds containing these moieties, as described in more detail below.

In certain embodiments, suitable condensation catalysts include an acid catalyst, a base catalyst, or an acid/base catalyst. As used herein, the term "acid/base catalyst" refers to a catalyst that has both an acid and a base functionality. In some embodiments the condensation catalyst can include, without limitation, zeolites, carbides, nitrides, zirconia, alumina, silica, aluminosilicates, phosphates, titanium oxides, zinc oxides, vanadium oxides, lanthanum oxides, yttrium oxides, scandium oxides, magnesium oxides, cerium oxides, barium oxides, calcium oxides, hydroxides, heteropolyacids, inorganic acids, acid modified resins, base modified resins, and any combination thereof. In some embodiments, the condensation catalyst can also include a modifier. Suitable modifiers include La, Y, Sc, P, B, Bi, Li, Na, K, Rb, Cs, Mg, Ca, Sr, Ba, and any combination thereof. In some embodiments, the condensation catalyst can also include a metal. Suitable metals include Cu, Ag, Au, Pt, Ni, Fe, Co, Ru, Zn, Cd, Ga, In, Rh, Pd, Ir, Re, Mn, Cr, Mo, W, Sn, Os, alloys, and any combination thereof.

In certain embodiments, the catalyst described in the condensation reaction may include a catalyst support as described above for the hydrogenation reaction. In certain embodiments, the condensation catalyst is self-supporting.

As used herein, the term "self-supporting" means that the catalyst does not need another material to serve as support. In other embodiments, the condensation catalyst in used in conjunction with a separate support suitable for suspending the catalyst. In an embodiment, the condensation catalyst support is silica.

The conditions under which the condensation reaction occurs will vary based on the type of starting material and the desired products. One of ordinary skill in the art, with the benefit of this disclosure, will recognize the appropriate conditions to use to carry out the reaction. In some embodiments, the condensation reaction is carried out at a temperature at which the thermodynamics for the proposed reaction are favorable. The temperature for the condensation reaction will vary depending on the specific starting polyol or alcohol. In some embodiments, the temperature for the condensation reaction is in a range from 80° C. to 500° C., and preferably from 125° C. to 450° C., and most preferably from 125° C. to 250° C. In some embodiments, the condensation reaction is conducted at pressures in a range between 0 Kpa to 9000 KPa, and preferably in a range between 0 KPa and 7000 KPa, and even more preferably between 0 KPa and 5000 KPa.

The higher alkanes formed by the invention include, but are not limited to, branched or straight chain alkanes that have from 4 to 30 carbon atoms, branched or straight chain alkenes that have from 4 to 30 carbon atoms, cycloalkanes that have from 5 to 30 carbon atoms, cycloalkenes that have from 5 to 30 carbon atoms, aryls, fused aryls, alcohols, and ketones. Suitable alkanes include, but are not limited to, butane, pentane, pentene, 2-methylbutane, hexane, hexene, 2-methylpentane, 3-methylpentane, 2,2,-dimethylbutane, 2,3-dimethylbutane, heptane, heptene, octane, octene, 2,2,4-trimethylpentane, 2,3-dimethyl hexane, 2,3,4-trimethylpentane, 2,3-dimethylpentane, nonane, nonene, decane, decene, undecane, undecene, dodecane, dodecene, tridecane, tridecene, tetradecane, tetradecene, pentadecane, pentadecene, nonyldecane, nonyldecene, eicosane, eicosene, uneicosane, uneicosene, doeicosane, doeicosene, trieicosane, trieicosene, tetraeicosane, tetraeicosene, and isomers thereof. Some of these products may be suitable for use as fuels.

In some embodiments, the cycloalkanes and the cycloalkenes are unsubstituted. In other embodiments, the cycloalkanes and cycloalkenes are mono-substituted. In still other embodiments, the cycloalkanes and cycloalkenes are multi-substituted. In the embodiments comprising the substituted cycloalkanes and cycloalkenes, the substituted group includes, without limitation, a branched or straight chain alkyl having 1 to 12 carbon atoms, a branched or straight chain alkylene having 1 to 12 carbon atoms, a phenyl, and any combination thereof. Suitable cycloalkanes and cycloalkenes include, but are not limited to, cyclopentane, cyclopentene, cyclohexane, cyclohexene, methyl-cyclopentane, methyl-cyclopentene, ethyl-cyclopentane, ethyl-cyclopentene, ethyl-cyclohexane, ethyl-cyclohexene, isomers and any combination thereof.

In some embodiments, the aryls formed are unsubstituted. In another embodiment, the aryls formed are mono-substituted. In the embodiments comprising the substituted aryls, the substituted group includes, without limitation, a branched or straight chain alkyl having 1 to 12 carbon atoms, a branched or straight chain alkylene having 1 to 12 carbon atoms, a phenyl, and any combination thereof. Suitable aryls for the invention include, but are not limited to, benzene, toluene, xylene, ethyl benzene, para xylene, meta xylene, and any combination thereof.

The alcohols produced in the invention have from 4 to 30 carbon atoms. In some embodiments, the alcohols are cyclic.

In other embodiments, the alcohols are branched. In another embodiment, the alcohols are straight chained. Suitable alcohols for the invention include, but are not limited to, butanol, pentanol, hexanol, heptanol, octanol, nonanol, decanol, undecanol, dodecanol, tridecanol, tetradecanol, pentadecanol, hexadecanol, heptyldecanol, octyldecanol, nonyldecanol, eicosanol, uneicosanol, doeicosanol, trieicosanol, tetraeicosanol, and isomers thereof.

The ketones produced in the invention have from 4 to 30 carbon atoms. In an embodiment, the ketones are cyclic. In another embodiment, the ketones are branched. In another embodiment, the ketones are straight chained. Suitable ketones for the invention include, but are not limited to, butanone, pentanone, hexanone, heptanone, octanone, nonanone, decanone, undecanone, dodecanone, tridecanone, tetradecanone, pentadecanone, hexadecanone, heptyldecanone, octyldecanone, nonyldecanone, eicosanone, uneicosanone, doeicosanone, trieicosanone, tetraeicosanone, and isomers thereof.

Another such chemical modification is interesterification. Naturally produced glycerolipids do not have a uniform distribution of fatty acid constituents. In the context of oils, interesterification refers to the exchange of acyl radicals between two esters of different glycerolipids. The interesterification process provides a mechanism by which the fatty acid constituents of a mixture of glycerolipids can be rearranged to modify the distribution pattern. Interesterification is a well-known chemical process, and generally comprises heating (to about 200° C.) a mixture of oils for a period (e.g, 30 minutes) in the presence of a catalyst, such as an alkali metal or alkali metal alkylate (e.g., sodium methoxide). This process can be used to randomize the distribution pattern of the fatty acid constituents of an oil mixture, or can be directed to produce a desired distribution pattern. This method of chemical modification of lipids can be performed on materials provided herein, such as microbial biomass with a percentage of dry cell weight as lipid at least 20%.

Directed interesterification, in which a specific distribution pattern of fatty acids is sought, can be performed by maintaining the oil mixture at a temperature below the melting point of some TAGs which might occur. This results in selective crystallization of these TAGs, which effectively removes them from the reaction mixture as they crystallize. The process can be continued until most of the fatty acids in the oil have precipitated, for example. A directed interesterification process can be used, for example, to produce a product with a lower calorie content via the substitution of longer-chain fatty acids with shorter-chain counterparts. Directed interesterification can also be used to produce a product with a mixture of fats that can provide desired melting characteristics and structural features sought in food additives or products (e.g., margarine) without resorting to hydrogenation, which can produce unwanted trans isomers.

Interesterification of oils produced by the methods described herein can be performed in conjunction with one or more of the methods and/or materials, or to produce products, as reported in the following: U.S. Pat. Nos. 6,080,853 (Non-digestible fat substitutes); 4,288,378 (Peanut butter stabilizer); 5,391,383 (Edible spray oil); 6,022,577 (Edible fats for food products); 5,434,278 (Edible fats for food products); 5,268,192 (Low calorie nut products); 5,258,197 (Reduce calorie edible compositions); 4,335,156 (Edible fat product); 7,288,278 (Food additives or medicaments); 7,115,760 (Fractionation process); 6,808,737 (Structural fats); 5,888,947 (Engine lubricants); 5,686,131 (Edible oil mixtures); and 4,603,188 (Curable urethane compositions).

In one embodiment in accordance with the invention, transesterification of the oil, as described above, is followed by reaction of the transesterified product with polyol, as reported in U.S. Pat. No. 6,465,642, to produce polyol fatty acid polyesters. Such an esterification and separation process may comprise the steps as follows: reacting a lower alkyl ester with polyol in the presence of soap; removing residual soap from the product mixture; water-washing and drying the product mixture to remove impurities; bleaching the product mixture for refinement; separating at least a portion of the unreacted lower alkyl ester from the polyol fatty acid polyester in the product mixture; and recycling the separated unreacted lower alkyl ester.

Transesterification can also be performed on microbial biomass with short chain fatty acid esters, as reported in U.S. Pat. No. 6,278,006. In general, transesterification may be performed by adding a short chain fatty acid ester to an oil in the presence of a suitable catalyst and heating the mixture. In some embodiments, the oil comprises about 5% to about 90% of the reaction mixture by weight. In some embodiments, the short chain fatty acid esters can be about 10% to about 50% of the reaction mixture by weight. Non-limiting examples of catalysts include base catalysts, sodium methoxide, acid catalysts including inorganic acids such as sulfuric acid and acidified clays, organic acids such as methane sulfonic acid, benzenesulfonic acid, and toluenesulfonic acid, and acidic resins such as Amberlyst 15. Metals such as sodium and magnesium, and metal hydrides also are useful catalysts.

Another such chemical modification is hydroxylation, which involves the addition of water to a double bond resulting in saturation and the incorporation of a hydroxyl moiety. The hydroxylation process provides a mechanism for converting one or more fatty acid constituents of a glycerolipid to a hydroxy fatty acid. Hydroxylation can be performed, for example, via the method reported in U.S. Pat. No. 5,576,027. Hydroxylated fatty acids, including castor oil and its derivatives, are useful as components in several industrial applications, including food additives, surfactants, pigment wetting agents, defoaming agents, water proofing additives, plasticizing agents, cosmetic emulsifying and/or deodorant agents, as well as in electronics, pharmaceuticals, paints, inks, adhesives, and lubricants. One example of how the hydroxylation of a glyceride may be performed is as follows: fat may be heated, preferably to about 30-50° C. combined with heptane and maintained at temperature for thirty minutes or more; acetic acid may then be added to the mixture followed by an aqueous solution of sulfuric acid followed by an aqueous hydrogen peroxide solution which is added in small increments to the mixture over one hour; after the aqueous hydrogen peroxide, the temperature may then be increased to at least about 60° C. and stirred for at least six hours; after the stirring, the mixture is allowed to settle and a lower aqueous layer formed by the reaction may be removed while the upper heptane layer formed by the reaction may be washed with hot water having a temperature of about 60° C.; the washed heptane layer may then be neutralized with an aqueous potassium hydroxide solution to a pH of about 5 to 7 and then removed by distillation under vacuum; the reaction product may then be dried under vacuum at 100° C. and the dried product steam-deodorized under vacuum conditions and filtered at about 50° to 60° C. using diatomaceous earth.

Hydroxylation of microbial oils produced by the methods described herein can be performed in conjuction with one or more of the methods and/or materials, or to produce products, as reported in the following: U.S. Pat. Nos. 6,590,113 (Oil-based coatings and ink); 4,049,724 (Hydroxylation process); 6,113,971 (Olive oil butter); 4,992,189 (Lubricants and lube additives); 5,576,027 (Hydroxylated milk); and 6,869,597 (Cosmetics). The hydroxylation of ricinoleic acid provides a polyol.

Hydroxylated glycerolipids can be converted to estolides. Estolides consist of a glycerolipid in which a hydroxylated fatty acid constituent has been esterified to another fatty acid molecule. Conversion of hydroxylated glycerolipids to estolides can be carried out by warming a mixture of glycerolipids and fatty acids and contacting the mixture with a mineral acid, as described by Isbell et al., *JAOCS* 71(2):169-174 (1994). Estolides are useful in a variety of applications, including without limitation those reported in the following: U.S. Pat. Nos. 7,196,124 (Elastomeric materials and floor coverings); 5,458,795 (Thickened oils for high-temperature applications); 5,451,332 (Fluids for industrial applications); 5,427,704 (Fuel additives); and 5,380,894 (Lubricants, greases, plasticizers, and printing inks).

Another such chemical modification is olefin metathesis. In olefin metathesis, a catalyst severs the alkylidene carbons in an alkene (olefin) and forms new alkenes by pairing each of them with different alkylidine carbons. The olefin metathesis reaction provides a mechanism for processes such as truncating unsaturated fatty acid alkyl chains at alkenes by ethenolysis, cross-linking fatty acids through alkene linkages by self-metathesis, and incorporating new functional groups on fatty acids by cross-metathesis with derivatized alkenes.

In conjunction with other reactions, such as transesterification and hydrogenation, olefin metathesis can transform unsaturated glycerolipids into diverse end products. These products include glycerolipid oligomers for waxes; short-chain glycerolipids for lubricants; homo- and hetero-bifunctional alkyl chains for chemicals and polymers; short-chain esters for biofuel; and short-chain hydrocarbons for jet fuel. Olefin metathesis can be performed on triacylglycerols and fatty acid derivatives, for example, using the catalysts and methods reported in U.S. Pat. No. 7,119,216, US Patent Pub. No. 2010/0160506, and U.S. Patent Pub. No. 2010/0145086.

Olefin metathesis of bio-oils generally comprises adding a solution of Ru catalyst at a loading of about 10 to 250 ppm under inert conditions to unsaturated fatty acid esters in the presence (cross-metathesis) or absence (self-metathesis) of other alkenes. The reactions are typically allowed to proceed from hours to days and ultimately yield a distribution of alkene products. One example of how olefin metathesis may be performed on a fatty acid derivative is as follows: A solution of the first generation Grubbs Catalyst (dichloro[2(1-methylethoxy-α-O)phenyl]methylene-α-C](tricyclohexylphosphine) in toluene at a catalyst loading of 222 ppm may be added to a vessel containing degassed and dried methyl oleate. Then the vessel may be pressurized with about 60 psig of ethylene gas and maintained at or below about 30° C. for 3 hours, whereby approximately a 50% yield of methyl 9-decenoate may be produced.

Olefin metathesis of oils produced by the methods described herein can be performed in conjunction with one or more of the methods and/or materials, or to produce products, as reported in the following: Patent App. PCT/US07/081,427 (α-olefin fatty acids) and U.S. patent application Ser. Nos. 12/281,938 (petroleum creams), 12/281,931 (paintball gun capsules), 12/653,742 (plasticizers and lubricants), 12/422,096 (bifunctional organic compounds), and 11/795,052 (candle wax).

Other chemical reactions that can be performed on microbial oils include reacting triacylglycerols with a cyclopropanating agent to enhance fluidity and/or oxidative stability, as reported in U.S. Pat. No. 6,051,539; manufacturing of waxes from triacylglycerols, as reported in U.S. Pat. No. 6,770,104; and epoxidation of triacylglycerols, as reported in "The effect of fatty acid composition on the acrylation kinetics of epoxidized triacylglycerols", Journal of the American Oil Chemists' Society, 79:1, 59-63, (2001) and Free Radical Biology and Medicine, 37:1, 104-114 (2004).

The generation of oil-bearing microbial biomass for fuel and chemical products as described above results in the production of delipidated biomass meal. Delipidated meal is a byproduct of preparing algal oil and is useful as animal feed for farm animals, e.g., ruminants, poultry, swine and aquaculture. The resulting meal, although of reduced oil content, still contains high quality proteins, carbohydrates, fiber, ash, residual oil and other nutrients appropriate for an animal feed. Because the cells are predominantly lysed by the oil separation process, the delipidated meal is easily digestible by such animals. Delipidated meal can optionally be combined with other ingredients, such as grain, in an animal feed. Because delipidated meal has a powdery consistency, it can be pressed into pellets using an extruder or expander or another type of machine, which are commercially available.

Castor oil is a naturally occurring oil isolated from castor beans. Hydrolysis of castor oil yields ricinoleic acid. The production of castor oil from castor beans is difficult because castor beans contain high amounts of ricin. Ricin is an extremely dangerous toxin listed as a schedule 1 compound in the Chemical Weapons Convention. Great care must therefore be taken in the production of castor oil from castor beans. A hydroxylated oil isolated from a microalgal cell is provided by an embodiment of the invention. In this way, ricinoleic acid can be produced. In one embodiment, the hydroxylated oil is a hydroxylated triglyceride. The hydroxylated triglyceride of the present invention may be chemically similar to castor oil. As shown in Example 7, the invention provides a hydroxylated microbial oil. The oil of Example 7, when analyzed by GC/MS, showed that the inventors have produced ricinoleic acid (12-hydroxy-9-cis-octadecenoic acid).

A fatty acid in accordance with an embodiment of the invention is a hydroxylated fatty acid. One embodiment of the hydroxylated fatty acid is ricinoleic acid.

The microbial hydroxylated oil or hydroxylated fatty acid can be further hydroxylated. When ricinoleic acid is further hydroxylated, a fatty acid containing two hydroxyl groups, a polyol, is produced.

The invention provides a composition prepared by reacting a polyol (e.g., hydroxylated oil and/or a hydroxylated fatty acid) with a compound that contains an isocyanate moiety. Polyurethanes using castor oil and an isocyanate have been produced. Polyurethanes are ubiquitous in the products we use today. Polyurethanes are found in automobiles, toys, atheletic equipment, consumer electronics, shoes, mattresses, cushions, adhesives, construction materials, and the like. Currently, polyurethanes made with castor oil are commercially available from BASF, Itoh Oil and others. Polyurethanes made with hydroxylated soybean oil are commercially available from Cargill, Dow, Bayer and others.

In an embodiment, ricinoleic acid produced by the microbial cells may be further processed into an oleochemical product, including a ricinoleic ester, ricinoleic amide, polyurethane, polyurethane foam, or polyurethane part according to methods known in the art. See, for example, U.S. Pat. Nos. 6,194,475, 4,266,617, 6,403,664, and 4,058,492, and US Patent Application No. 20100227151.

The invention, having been described in detail above, is exemplified in the following examples, which are offered to illustrate, but not to limit, the claimed invention.

VII. EXAMPLES

Example 1

Methods for Culturing *Prototheca*

*Prototheca* strains were cultivated to achieve a high percentage of oil by dry cell weight. Cryopreserved cells were thawed at room temperature and 500 ul of cells were added to 4.5 ml of medium (4.2 g/L $K_2HPO_4$, 3.1 g/L $NaH_2PO_4$, 0.24 g/L $MgSO_4.7H_2O$, 0.25 g/L Citric Acid monohydrate, 0.025 g/L $CaCl_2$ $2H_2O$, 2 g/L yeast extract) plus 2% glucose and grown for 7 days at 28° C. with agitation (200 rpm) in a 6-well plate. Dry cell weights were determined by centrifuging 1 ml of culture at 14,000 rpm for 5 min in a pre-weighed Eppendorf tube. The culture supernatant was discarded and the resulting cell pellet washed with 1 ml of deionized water. The culture was again centrifuged, the supernatant discarded, and the cell pellets placed at −80° C. until frozen. Samples were then lyophilized for 24 hrs and dry cell weights calculated. For determination of total lipid in cultures, 3 ml of culture was removed and subjected to analysis using an Ankom system (Ankom Inc., Macedon, N.Y.) according to the manufacturer's protocol. Samples were subjected to solvent extraction with an Amkom XT10 extractor according to the manufacturer's protocol. Total lipid was determined as the difference in mass between acid hydrolyzed dried samples and solvent extracted, dried samples. Percent oil dry cell weight measurements are shown in Table 10.

TABLE 10

Percent oil by dry cell weight

| Species | Strain | % Oil |
|---|---|---|
| Prototheca stagnora | UTEX 327 | 13.14 |
| Prototheca moriformis | UTEX 1441 | 18.02 |
| Prototheca moriformis | UTEX 1435 | 27.17 |

Microalgae samples from multiple strains from the genus *Prototheca* were genotyped. Genomic DNA was isolated from algal biomass as follows. Cells (approximately 200 mg) were centrifuged from liquid cultures 5 minutes at 14,000×g. Cells were then resuspended in sterile distilled water, centrifuged 5 minutes at 14,000×g and the supernatant discarded. A single glass bead ~2 mm in diameter was added to the biomass and tubes were placed at −80° C. for at least 15 minutes. Samples were removed and 150 ul of grinding buffer (1% Sarkosyl, 0.25 M Sucrose, 50 mM NaCl, 20 mM EDTA, 100 mM Tris-HCl, pH 8.0, RNase A 0.5 ug/ul) was added. Pellets were resuspended by vortexing briefly, followed by the addition of 40 ul of 5M NaCl. Samples were vortexed briefly, followed by the addition of 66 μl of 5% CTAB (Cetyl trimethylammonium bromide) and a final brief vortex. Samples were next incubated at 65° C. for 10 minutes after which they were centrifuged at 14,000×g for 10 minutes. The supernatant was transferred to a fresh tube and extracted once with 300 μl of Phenol:Chloroform:Isoamyl alcohol 12:12:1, followed by centrifugation for 5 minutes at 14,000×g. The resulting aqueous phase was transferred to a fresh tube containing 0.7 vol of isopropanol (~190 μl), mixed by inversion and incubated at room temperature for 30 minutes or overnight at 4° C. DNA was recovered via centrifugation at 14,000×g for 10 minutes. The resulting pellet was then washed twice with 70% ethanol, followed by a final wash with 100% ethanol. Pellets were air dried for 20-30 minutes at room temperature followed by resuspension in 50 μl of 10 mM TrisCl, 1 mM EDTA (pH 8.0).

Five μl of total algal DNA, prepared as described above, was diluted 1:50 in 10 mM Tris, pH 8.0. PCR reactions, final volume 20 μl, were set up as follows. Ten μl of 2×iProof HF master mix (BIO-RAD) was added to 0.4 μl primer SZ02613 (5'-TGTTGAAGAATGAGCCGGCGAC-3' (SEQ ID NO:9) at 10 mM stock concentration). This primer sequence runs from position 567-588 in Gen Bank accession no. L43357 and is highly conserved in higher plants and algal plastid genomes. This was followed by the addition of 0.4 μl primer SZ02615 (5'-CAGTGAGCTATTACGCACTC-3' (SEQ ID NO:10) at 10 mM stock concentration). This primer sequence is complementary to position 1112-1093 in Gen Bank accession no. L43357 and is highly conserved in higher plants and algal plastid genomes. Next, 5 μl of diluted total DNA and 3.2 μl $dH_2O$ were added. PCR reactions were run as follows: 98° C., 45"; 98° C., 8"; 53° C., 12"; 72° C., 20" for 35 cycles followed by 72° C. for 1 min and holding at 25° C. For purification of PCR products, 20 μl of 10 mM Tris, pH 8.0, was added to each reaction, followed by extraction with 40 μl of Phenol:Chloroform:isoamyl alcohol 12:12:1, vortexing and centrifuging at 14,000×g for 5 minutes. PCR reactions were applied to S-400 columns (GE Healthcare) and centrifuged for 2 minutes at 3,000×g. Purified PCR products were subsequently TOPO cloned into PCR8/GW/TOPO and positive clones selected for on LB/Spec plates. Purified plasmid DNA was sequenced in both directions using M13 forward and reverse primers. In total, twelve *Prototheca* strains were selected to have their 23S rRNA DNA sequenced and the sequences are listed in the Sequence Listing. A summary of the strains and Sequence Listing Numbers is included below. The sequences were analyzed for overall divergence from the UTEX 1435 (SEQ ID NO: 15) sequence. Two pairs emerged (UTEX 329/UTEX 1533 and UTEX 329/UTEX 1440) as the most divergent. In both cases, pairwise alignment resulted in 75.0% pairwise sequence identity. The percent sequence identity to UTEX 1435 is also included below:

| Species | Strain | % nt identity | SEQ ID NO. |
|---|---|---|---|
| Prototheca kruegani | UTEX 329 | 75.2 | SEQ ID NO: 11 |
| Prototheca wickerhamii | UTEX 1440 | 99 | SEQ ID NO: 12 |
| Prototheca stagnora | UTEX 1442 | 75.7 | SEQ ID NO: 13 |
| Prototheca moriformis | UTEX 288 | 75.4 | SEQ ID NO: 14 |
| Prototheca moriformis | UTEX 1439; 1441; 1435; 1437 | 100 | SEQ ID NO: 15 |
| Prototheca wikerhamii | UTEX 1533 | 99.8 | SEQ ID NO: 16 |
| Prototheca moriformis | UTEX 1434 | 75.9 | SEQ ID NO: 17 |
| Prototheca zopfii | UTEX 1438 | 75.7 | SEQ ID NO: 18 |
| Prototheca moriformis | UTEX 1436 | 88.9 | SEQ ID NO: 19 |

Lipid samples from a subset of the above-listed strains were analyzed for lipid profile using HPLC. Results are shown below in Table 11. Alternatively, lipid profiles can be determined using the procedure outlines in Example 11.

TABLE 11

Diversity of lipid chains in *Protheca* species

| Strain | C14:0 | C16:0 | C16:1 | C18:0 | C18:1 | C18:2 | C18:3 | C20:0 | C20:1 |
|---|---|---|---|---|---|---|---|---|---|
| UTEX 327 | 0 | 12.01 | 0 | 0 | 50.33 | 17.14 | 0 | 0 | 0 |
| UTEX 1441 | 1.41 | 29.44 | 0.70 | 3.05 | 57.72 | 12.37 | 0.97 | 0.33 | 0 |
| UTEX 1435 | 1.09 | 25.77 | 0 | 2.75 | 54.01 | 11.90 | 2.44 | 0 | 0 |

Oil extracted from *Prototheca moriformis* UTEX 1435 (via solvent extraction or using an expeller press was analyzed for carotenoids, chlorophyll, tocopherols, other sterols and tocotrienols. The results are summarized below in Table 12.

TABLE 12

Carotenoid, chlorophyll, tocopherol/sterols and tocotrienol analysis in oil extracted from *Prototheca moriformis* (UTEX 1435).

|  | Pressed oil (mcg/ml) | Solvent extracted oil (mcg/ml) |
|---|---|---|
| cis-Lutein | 0.041 | 0.042 |
| trans-Lutein | 0.140 | 0.112 |
| trans-Zeaxanthin | 0.045 | 0.039 |
| cis-Zeaxanthin | 0.007 | 0.013 |
| t-alpha-Crytoxanthin | 0.007 | 0.010 |
| t-beta-Crytoxanthin | 0.009 | 0.010 |
| t-alpha-Carotene | 0.003 | 0.001 |
| c-alpha-Carotene | none detected | none detected |
| t-beta-Carotene | 0.010 | 0.009 |
| 9-cis-beta-Carotene | 0.004 | 0.002 |
| Lycopene | none detected | none detected |
| Total Carotenoids | 0.267 | 0.238 |
| Chlorophyll | <0.01 mg/kg | <0.01 mg/kg |
| Tocopherols and Sterols | | |
| | Pressed oil (mg/100 g) | Solvent extracted oil (mg/100 g) |
| gamma Tocopherol | 0.49 | 0.49 |
| Campesterol | 6.09 | 6.05 |
| Stigmasterol | 47.6 | 47.8 |
| Beta-sitosterol | 11.6 | 11.5 |
| Other sterols | 445 | 446 |
| Tocotrienols | | |
| | Pressed oil (mg/g) | Solvent extracted oil (mg/g) |
| alpha Tocotrienol | 0.26 | 0.26 |
| beta Tocotrienol | <0.01 | <0.01 |
| gamma Tocotrienol | 0.10 | 0.10 |
| detal Tocotrienol | <0.01 | <0.01 |
| Total Tocotrienols | 0.36 | 0.36 |

Oil extracted from *Prototheca moriformis*, from four separate lots, were refined and bleached using standard vegetable oil processing methods. Briefly, crude oil extracted from *Prototheca moriformis* was clarified in a horizontal decanter, where the solids were separated from the oil. The clarified oil was then transferred to a tank with citric acid and water and left to settle for approximately 24 hours. After 24 hours, the mixture in the tank formed 2 separate layers. The bottom layer was composed of water and gums that were then removed by decantation prior to transferring the degummed oil into a bleaching tank. The oil was then heated along with another dose of citric acid. Bleaching clay was then added to the bleaching tank and the mixture was further heated under vacuum in order to evaporate off any water that was present. The mixture was then pumped through a leaf filter in order to remove the bleaching clay. The filtered oil was then passed through a final 5 μm polishing filter and then collected for storage until use. The refined and bleached (RB) oil was then analyzed for carotenoids, chlorophyll, sterols, tocotrienols and tocopherols. The results of these analyses are summarized in Table 13 below. "Nd" denotes none detected and the sensitivity of detection is listed below:

Sensitivity of Detection
Carotenoids (mcg/g) nd=<0.003 mcg/g
Chlorophyll (mcg/g) nd=<0.03 mcg/g
Sterols (%) nd=0.25%
Tocopherols (mcg/g); nd=3 mcg/g

TABLE 13

Carotenoid, chlorophyll, sterols, tocotrienols and tocopherol analysis from refined and bleached *Prototheca moriformis* oil.

|  | Lot A | Lot B | Lot C | Lot D |
|---|---|---|---|---|
| Carotenoids (mcg/g) | | | | |
| Lutein | 0.025 | 0.003 | nd | 0.039 |
| Zeaxanthin | nd | nd | nd | nd |
| cis-Lutein/Zeaxanthin | nd | nd | nd | nd |
| trans-alpha-Cryptoxanthin | nd | nd | nd | nd |
| trans-beta-Cryptoxanthin | nd | nd | nd | nd |
| trans-alpha-Carotene | nd | nd | nd | nd |
| cis-alpha-Carotene | nd | nd | nd | nd |
| trans-beta-Carotene | nd | nd | nd | nd |
| cis-beta-Carotene | nd | nd | nd | nd |
| Lycopene | nd | nd | nd | nd |
| Unidentified | 0.219 | 0.066 | 0.050 | 0.026 |
| Total Carotenoids | 0.244 | 0.069 | 0.050 | 0.065 |
| Chlorophyll (mcg/g) | | | | |
| Chlorophyll A | 0.268 | 0.136 | 0.045 | 0.166 |
| Chlorophyll B | nd | nd | nd | nd |
| Total Chlorophyll | 0.268 | 0.136 | 0.045 | 0.166 |
| Sterols (%) | | | | |
| Brassicasterol | nd | nd | nd | nd |
| Campesterol | nd | nd | nd | nd |
| Stigmasterol | nd | nd | nd | nd |
| beta-Sitosterol | nd | nd | nd | nd |
| Total Sterols | nd | nd | nd | nd |
| Tocopherols (mcg/g) | | | | |
| alpha-Tocopherol | 23.9 | 22.8 | 12.5 | 8.2 |
| beta-Tocopherol | 3.72 | nd | nd | nd |
| gamma-Tocopherol | 164 | 85.3 | 43.1 | 38.3 |
| delta-Tocopherol | 70.1 | 31.1 | 18.1 | 14.3 |
| Total Tocopherols | 262 | 139.2 | 73.7 | 60.8 |
| Tocotrienols (mcg/g) | | | | |
| alpha-Tocotrienol | 190 | 225 | 253 | 239 |
| beta-Tocotrienol | nd | nd | nd | nd |

TABLE 13-continued

Carotenoid, chlorophyll, sterols, tocotrienols and tocopherol analysis from refined and bleached *Prototheca moriformis* oil.

|  | Lot A | Lot B | Lot C | Lot D |
|---|---|---|---|---|
| gamma-Tocotrienol | 47.3 | 60.4 | 54.8 | 60.9 |
| delta-Tocotrienol | 12.3 | 16.1 | 17.5 | 15.2 |
| Total Tocotrienols | 250 | 302 | 325 | 315 |

The same four lots of *Prototheca moriformis* oil was also analyzed for trace elements and the results are summarized below in Table 14.

TABLE 14

Elemental analysis of refined and bleached *Prototheca moriformis* oil.

|  | Lot A | Lot B | Lot C | Lot D |
|---|---|---|---|---|
| Elemental Analysis (ppm) | | | | |
| Calcium | 0.08 | 0.07 | <0.04 | 0.07 |
| Phosphorous | <0.2 | 0.38 | <0.2 | 0.33 |
| Sodium | <0.5 | 0.55 | <0.5 | <0.5 |
| Potassium | 1.02 | 1.68 | <0.5 | 0.94 |
| Magnesium | <0.04 | <0.04 | <0.04 | 0.07 |
| Manganese | <0.05 | <0.05 | <0.05 | <0.05 |
| Iron | <0.02 | <0.02 | <0.02 | <0.02 |
| Zinc | <0.02 | <0.02 | <0.02 | <0.02 |
| Copper | <0.05 | <0.05 | <0.05 | <0.05 |
| Sulfur | 2.55 | 4.45 | 2.36 | 4.55 |
| Lead | <0.2 | <0.2 | <0.2 | <0.2 |
| Silicon | 0.37 | 0.41 | 0.26 | 0.26 |
| Nickel | <0.2 | <0.2 | <0.2 | <0.2 |
| Organic chloride | <1.0 | <1.0 | <1.0 | 2.2 |
| Inorganic chloride | <1.0 | <1.0 | <1.0 | <1.0 |
| Nitrogen | 4.4 | 7.8 | 4.2 | 6.9 |
| Lithium | <0.02 | <0.02 | <0.02 | <0.02 |
| Boron | 0.07 | 0.36 | 0.09 | 0.38 |
| Aluminum | — | <0.2 | <0.2 | <0.2 |
| Vanadium | <0.05 | <0.05 | <0.05 | <0.05 |
| Lovibond Color (° L) | | | | |
| Red | 5.0 | 4.3 | 3.2 | 5.0 |
| Yellow | 70.0 | 70.0 | 50.0 | 70.0 |
| Mono & Diglycerides by HPLC (%) | | | | |
| Diglycerides | 1.68 | 2.23 | 1.25 | 1.61 |
| Monoglycerides | 0.03 | 0.04 | 0.02 | 0.03 |
| Free fatty acids (FFA) | 1.02 | 1.72 | 0.86 | 0.83 |
| Soaps | 0 | 0 | 0 | 0 |
| Oxidized and Polymerized Triglycerides | | | | |
| Oxidized Triglycerides (%) | 3.41 | 2.41 | 4.11 | 1.00 |
| Polymerized Triglycerides (%) | 1.19 | 0.45 | 0.66 | 0.31 |
| Peroxide Value (meg/kg) | 0.75 | 0.80 | 0.60 | 1.20 |
| p-Anisidine value (dimensionless) | 5.03 | 9.03 | 5.44 | 20.1 |
| Water and Other Impurities (%) | | | | |
| Karl Fisher Moisture | 0.8 | 0.12 | 0.07 | 0.18 |
| Total polar compounds | 5.02 | 6.28 | 4.54 | 5.23 |
| Unsaponifiable matter | 0.92 | 1.07 | 0.72 | 1.04 |
| Insoluble impurities | <0.01 | <0.01 | 0.01 | <0.01 |
| Total oil (%) | | | | |
| Neutral oil | 98.8 | 98.2 | 99.0 | 98.9 |

Example 2

General Methods for Biolistic Transforming *Prototheca*

Seashell Gold Microcarriers 550 nanometers were prepared according to the protocol from manufacturer. Plasmid (20 µg) was mixed with 50 µl of binding buffer and 60 µl (30 mg) of S550d gold carriers and incubated in ice for 1 min. Precipitation buffer (100 µl) was added, and the mixture was incubated in ice for another 1 min. After vortexing, DNA-coated particles were pelleted by spinning at 10,000 rpm in an Eppendorf 5415C microfuge for 10 seconds. The gold pellet was washed once with 500 µl of cold 100% ethanol, pelleted by brief spinning in the microfuge, and resuspended with 50 µl of ice-cold ethanol. After a brief (1-2 sec) sonication, 10 µl of DNA-coated particles were immediately transferred to the carrier membrane.

*Prototheca* strains were grown in proteose medium (2 g/L yeast extract, 2.94 mM NaNO3, 0.17 mM CaCl2.2H2O, 0.3 mM MgSO4.7H2O, 0.4 mM K2HPO4, 1.28 mM KH2PO4, 0.43 mM NaCl) with 2% glucose on a gyratory shaker until it reaches a cell density of $2 \times 10^6$ cells/ml. The cells were harvested, washed once with sterile distilled water, and resuspended in 50 µl of medium. $1 \times 10^7$ cells were spread in the center third of a non-selective proteose media plate. The cells were bombarded with the PDS-1000/He Biolistic Particle Delivery system (Bio-Rad). Rupture disks (1350 psi) were used, and the plates are placed 6 cm below the screen/macrocarrier assembly. The cells were allowed to recover at 25° C. for 12-24 h. Upon recovery, the cells were scraped from the plates with a rubber spatula, mixed with 100 µl of medium and spread on plates containing the appropriate antibiotic selection. After 7-10 days of incubation at 25° C., colonies representing transformed cells were visible on the plates. Colonies were picked and spotted on selective (either antibiotic or carbon source) agar plates for a second round of selection.

Example 3

Expression of Various Thioesterases in *Prototheca*

Methods and effects of expressing a heterologous thioesterase gene in *Prototheca* species have been previously described in PCT Application No. PCT/US2009/066142, hereby incorporated by reference. The effect of other thioesterase genes/gene products from higher plants species was further investigated. These thioesterases include thioesterases from the following higher plants:

| Species | GenBank Accession No. | Specificity | SEQ ID NO: |
|---|---|---|---|
| *Cinnamomum camphora* | Q39473 | C14 | SEQ ID NOs: 30-31 |
| *Umbellularia californica* | Q41635 | C10-C12 | SEQ ID NOs: 34-35 |
| *Cuphea hookeriana* | AAC49269 | C8-C10 | SEQ ID NOs: 32-33 |
| *Cuphea palustris* | AAC49179 | C8 | SEQ ID NOs: 36-37 |
| *Cuphea lanceolata* | CAB60830 | C10 | SEQ ID NOs: 38-39 |
| *Iris germanica* | AAG43858.1 | C14 | SEQ ID NOs: 40-41 |
| *Myristica fragrans* | AAB717291.1 | C14 | SEQ ID NOs: 42-43 |
| *Cuphea palustris* | AAC49180 | C14 | SEQ ID NOs: 44-45 |
| *Ulmus americana* | AAB71731 | broad | SEQ ID NOs: 46-47 |
| *Myristica fragrans* | AAB71729 | broad | SEQ ID NOs: 145-146 |
| *Garcinia mangostana* | AAB51525.1 | C16 | SEQ ID NOs: 147-148 |
| *Cuphea hookeriana* | Q39513.1 | C16 | SEQ ID NOs: 149-150 |

-continued

| Species | GenBank Accession No. | Specificity | SEQ ID NO: |
|---|---|---|---|
| Elaeis guiniensis | AAD42220.2 | C16 | SEQ ID NO: 151-152 |
| Brassica napus | CAA52070.1 | C18 | SEQ ID NO: 153-154 |
| Ricinus communis | ABS30422.1 | C18:1 | SEQ ID NO: 155-156 |

In all cases, each of the above thioesterase constructs was transformed in to *Prototheca moriformis* (UTEX 1435) using biolistic particle bombardment. Other transformation methods including homologous recombination as disclosed in PCT Application No. PCT/US2009/066142, would also be suitable for heterologous expression of genes of interest. Transformation of *Prototheca moriformis* (UTEX 1435) with each of the above thioesterase constructs was performed using the methods described in Example 2. Each of the constructs contained a NeoR gene and selection for positive clones was carried out using 100 μg/ml G418. All coding regions were codon optimized to reflect the codon bias inherent in *Prototheca moriformis* UTEX 1435 (see Table 2) nuclear genes. Both amino acid sequences and the cDNA sequences for the construct used are listed in the sequence identity listing. Unless otherwise specified, the transit peptide for each of the higher plant thioesterase was replaced with an algal codon optimized transit peptide from *Prototheca moriformis* delta 12 fatty acid desaturase (SEQ ID NO: 48)) or from *Chlorella prototheocoides* stearoyl ACP desaturase (SEQ ID NO: 49). All thioesterase constructs were driven by the *Chlamydomanas reinhardtii* beta-tubulin promoter/5'UTR. Growth and lipid production of selected positive clones were compared to wildtype (untransformed) *Prototheca moriformis* (UTEX 1435). Wildtype and selected positive clones were grown on 2% glucose G418 plates. Lipid profiles analysis on selected positive clones for each construct is summarized below (expressed in Area %) in Table 15.

other attributes of lipid profiles produced by microalgae, namely the degree of saturation of the fatty acids.

Selected clones transformed with *C. palustris* C8 thioesterase, *C. hookeriana* thioesterase, *U. californica* and *C. camphora* thioesterase were further grown in varing amounts of G418 (from 25 mg/L to 50 mg/L) and at varying temperatures (from 22° C. to 25° C.) and the lipid profile was determined for these clones. Table 16 summarizes the lipid profile (in Area %) of representative clones containing each thioesterase. A second construct containing the *U. americana* thioesterase was constructed and transformed into *Prototheca moriformis* (UTEX 1435) using the biolistic methods described above. This second construct was introduced into the cell via homologous recombination. Methods of homologous recombination in *Prototheca* species were described previously in PCT Application No. PCT/US2009/66142. The homologous DNA that was used was from the 6S genomic DNA sequence from *Prototheca moriformis* UTEX 1435 (donor sequences given in SEQ ID 92 and SEQ ID 84) The selection agent was the ability to grow on sucrose, using a codon optimized suc2 gene from *S. cereveisiae* driven by the *C. reinhardtii* beta tubulin promoter. The native *U. americana* transit peptide was replaced by the *Chlorella prototheocoides* (UTEX 250) stearoyl ACP desaturase transit peptide. The cDNA of this construct is listed in the Sequence Listing as SEQ ID NO: 50. Selection of positive clones was performed on 2% sucrose plates and the resulting cultures for lipid profile determination was also grown on 2% sucrose containing medium. A representative lipid profile for this *Prototheca moriformis* strain containing a homologously recombined heterologous *U. americana* thioesterase is summarized in Table 16.

TABLE 15

Lipid profiles of *Prototheca moriformis* expressing various heterologous thioesterases.

| | | | | | Thioesterase | | | | | |
|---|---|---|---|---|---|---|---|---|---|---|
| Fatty Acid | UTEX 1435 wt | U. californica | C. camphora | I. germanica | M. fragrans | C. palustris C8:0 | C. hookeriana | C. lanceolata | C. palustris C14:0 | U. americana |
| C8:0 | 0 | 0 | 0 | 0 | | 3.1 | 1.8 | 0 | 0 | .09 |
| C10:0 | 0.02 | .07 | .02 | .01 | .09 | .56 | 6.85 | 1.91 | .01 | 2.85 |
| C12:0 | 0.05 | 14 | 1.82 | .09 | .05 | .25 | .2 | .29 | .06 | .74 |
| C14:0 | 1.65 | 3 | 17.3 | 2.59 | 5.31 | 1.45 | 1.8 | 1.83 | 2.87 | 10.45 |
| C16:0 | 28.0 | 21.4 | 24.3 | 26.52 | 31.08 | 22.84 | 23.9 | 25.55 | 27.23 | 33.3 |
| C18:0 | 2.9 | 2.9 | 2.7 | 3.11 | 2.71 | 3.24 | 2.8 | 3.26 | 3.62 | 3.47 |
| C18:1 | 53.8 | 45.2 | 41.3 | 49.96 | 39.77 | 56.62 | 49.8 | 55.43 | 51.04 | 38.71 |
| C18:2 | 10.95 | 10 | 9.7 | 11.86 | 14.17 | 8.24 | 9.7 | 8.17 | 10.81 | 7.38 |
| C18:3 α | 0.8 | .86 | .8 | .40 | .64 | .61 | .9 | .58 | .97 | .52 |
| Total saturates (area %) | 32.62 | 44.97 | 46.14 | 32.32 | 39.24 | 31.44 | 37.35 | 32.84 | 33.79 | 50.9 |

The results show that all of the thioesterases expressed impacted fatty acid profiles to some level. Looking at the "Total saturates" row, the degree of saturation was profoundly impacted by the expression of several of the thioesterases, including those from *U. californica*, *C. camphora*, and most notably, *U. americana*. These changes in the percentage of total saturates were unexpected in that the heterologous expression of thioesterases from higher plants can apparently impact more than just lipid chain lengths; it can also impact

TABLE 16

Lipid profiles of *Prototheca moriformis* strains containing heterologous thioesterase genes.

| | C. palustris C8 | C. hookeriana | C. camphora | U. americana 2 |
|---|---|---|---|---|
| C8:0 | 12.28 | 2.37 | 0 | 0 |
| C10:0 | 2.17 | 12.09 | 0.02 | 4.69 |
| C12:0 | 0.34 | 0.33 | 3.81 | 1.02 |

TABLE 16-continued

Lipid profiles of *Protheca moriformis* strains containing heterologous thioesterase genes.

| | C. palustris C8 | C. hookeriana | C. camphora | U. americana 2 |
|---|---|---|---|---|
| C14:0 | 1.59 | 2.08 | 32.73 | 16.21 |
| C16:0 | 15.91 | 20.07 | 24.03 | 38.39 |
| C18:0 | 1.59 | 1.57 | 1.21 | 2.83 |
| C18:1 | 50.64 | 41.80 | 18.64 | 27.22 |
| C18:2 | 13.02 | 16.37 | 16.57 | 7.65 |
| C18:3 α | 1.52 | 1.75 | 1.66 | 0.74 |
| Total saturates | 33.88 | 38.51 | 61.80 | 63.14 |

As with the clones described above, all transformants containing a heterologous thioesterase gene showed impacted fatty acid profiles to some level, and the total percent of saturated fatty acids were also changed, as compared to wild-type (untransformed) *Prototheca moriformis*. The *Prototheca moriformis* containing the *U. americana* thioesterase introduced by homologous recombination had the greatest increase in total saturates.

Additionally, transgenic clones containing the exogenous *C. hookeriana*, *C. camphora*, *U. californica* or *U. americana* thioesterase were assessed for novel lipid profiles. The *C. hookeriana* thioesterase containing clone achieved the following lipid profile when grown in 2% glucose, 25 mg/ml G418 at 22° C.: 5.10% C8:0; 18.28% C10:0; 0.41% C12:0; 1.76% C14:0; 16.31% C16:0; 1.40% C18:0; 40.49% C18:1; and 13.16% C18:2. The *C. camphora* thioesterase-containing clone (also containing an exogenous sucrose invertase) achieved the following lipid profile when grown in 2% sucrose at 25° C.: 0.04% C10:0; 6.01% C12:0; 35.98% C14:0; 19.42 C16:0; 1.48% C18:0; 25.44% C18:1; and 9.34% C18:2. The *U. calfornica* thioesterase containing clone achieved the following lipid profile when grown in 2% glucose, 25-100 mg/ml G418 at 22° C.: 0% C8:0; 0.11% C10:0; 34.01% C12:0; 5.75% C14:0; 14.02% C16:0; 1.10% C18:0; 28.93% C18:1; and 13.01% C18:2. The *U. americana* thioesterase containing clone achieved the following lipid profile when grown in 2% glucose at 28° C.: 1.54% C10:0; 0.43% C12:0; 7.56% C14:0; 39.45% C16:0; 2.49% C18:0; 38.49% C18:1; and 7.88% C18:2.

Additional thioesterases from higher plants were also introduced into a *Prototheca moriformis* UTEX 1435 genetic background, and the codon-optimized cDNA sequences and amino acid sequences are listed in the Sequence Listing as specified above. These additional thioesterases include a broad specificity thioesterase (C14:0-C18:0) from *Myristica fragrans*, a C16:0-preferring thioesterase from *Garcinia mangostana*, a C16:0-preferring thioesterase from *Cuphea hookeriana*, a C16:0-preferring thioesterase from *Elaeis guiniensis*, a C18:0-preferring thioesterase from *Brassica napus*, and a C18:1-preferring thioesterase from *Ricinus communis*. Details of the expression constructs and the resulting transgenic clones from each of the above transgene/transformations are described below.

A broad specificity thioesterase (C14:0-C18:0) thioesterase from *Myristica fragrans* was introduced into a *Prototheca moriformis* UTEX 1435 genetic background using methods described above. Two different expression constructs were tested, each containing a different plastid targeting sequences. In both constructs, the *S. cerevisiae* sucrose invertase gene suc2 was utilized as a selectable marker, conferring to positive transformants the ability to grow on plates with sucrose as the sole carbon source. Both expression constructs, pSZ1318 and pSZ1317 contained a 5' (SEQ ID NO: 82) and 3' (SEQ ID NO: 84) homologous recombination targeting sequences (flanking the construct) to the 6S genomic region for integration into the nuclear genome and a *S. cerevisiae* suc2 sucrose invertase coding region under the control of *C. reinhardtii* β-tubulin promoter/5'UTR and *Chlorella vulgaris* nitrate reductase 3' UTR. This *S. cerevisiae* suc2 expression cassette is listed as SEQ ID NO: 159. pSZ1318 contained the *M. fragrans* thioesterase coding region with the native transit peptide replaced with the transit peptide from *Prototheca moriformis* delta 12 FAD (SEQ ID NO: 48) under the control of the *Prototheca moriformis* Amt03 promoter (SEQ ID NO: 89) and the *C. vulgaris* nitrate reductase 3'UTR. The codon-optimized *M. fragrans* thioesterase with the transit peptide from *Prototheca moriformis* delat 12 FAD is listed as SEQ ID NO: 145. pSZ1317 contained the *M. fragrans* coding region with the native transit peptide replaced with the transit peptide from *Chlorella protothecoides* stearoyl ACP desaturase (SEQ ID NO: 49) under the control of the *Prototheca moriformis* Amt03 promoter (SEQ ID NO: 89) and the *C. vulgaris* nitrate reductase 3' UTR. The codon-optimized *M. fragrans* thioesterase with the transit peptide from *C. protothecoides* stearoyl ACP desaturase is listed as SEQ ID NO: 158. Both expression constructs, pSZ1318 and pSZ1317 were transformed into *Prototheca* cells and selection was carried out on plates where sucrose was the sole-carbon source. Positive clones were selected from each transformation and grown in medium with sucrose as the sole carbon source under nitrogen-limited conditions for lipid production. Lipid profiles of a subset of the positive clones selected were determined using direct transesterification methods described above and are summarized in Table 17.

TABLE 17

Lipid profiles of *Myristica fragrans* broad specificity thioesterase transgenic *Prototheca* cells.

| Strain | C10:0 | C12:0 | C14:0 | C16:0 | C18:0 | C18:1 | C18:2 |
|---|---|---|---|---|---|---|---|
| wildtype | 0.01 | 0.03 | 1.17 | 25.86 | 2.84 | 58.33 | 9.16 |
| pSZ1318 clone A | 0.03 | 0.23 | 16.09 | 37.72 | 6.11 | 27.39 | 9.98 |
| pSZ1318 clone B | 0.03 | 0.22 | 15.74 | 37.17 | 6.23 | 28.16 | 9.94 |
| pSZ1318 clone C | 0.03 | 0.22 | 14.97 | 36.05 | 5.87 | 30.48 | 9.86 |

TABLE 17-continued

Lipid profiles of *Myristica fragrans* broad specificity thioesterase transgenic *Prototheca* cells.

| Strain | C10:0 | C12:0 | C14:0 | C16:0 | C18:0 | C18:1 | C18:2 |
|---|---|---|---|---|---|---|---|
| pSZ1317 clone A | 0.02 | 0.21 | 15.23 | 36.62 | 5.11 | 31.83 | 8.76 |
| pSZ1317 clone B | 0.03 | 0.27 | 18.06 | 38.88 | 5.64 | 26.11 | 8.90 |
| pSZ1317 clone C | 0.02 | 0.24 | 16.19 | 37.02 | 5.61 | 29.52 | 9.19 |

The positive clones containing a *Myristica fragrans* thioesterase transgene displayed altered lipid profiles. However, the above summarized results showed an unexpected result; in higher plants, the *Myristica fragrans* thioesterase exhibits significant activity on C16:0 fatty acyl-ACPs (Voelker et al., 1997), whereas, in *Prototheca* cells, the *Myristica fragrans* thioesterase seem to have a gradation of impact on C14:0>C18:0>C16:0 and is more broad based than just C16:0.

A C16:0-preferring thioesterase from *Garcinia mangostana* was introduced into a *Prototheca moriformis* UTEX 1435 genetic background, and the codon-optimized cDNA sequences and amino acid sequences are listed in the Sequence Listing as specified above. The expression construct contained a 5' (SEQ ID NO: 82) and 3' (SEQ ID NO: 84) homologous recombination targeting sequences (flanking the construct) to the 6S genomic region for integration into the nuclear genome and a *S. cerevisiae* suc2 sucrose invertase coding region under the control of *C. reinhardtii* β-tubulin promoter/5'UTR and *Chlorella vulgaris* nitrate reductase 3' UTR. This *S. cerevisiae* suc2 expression cassette is listed as SEQ ID NO: 159 and served as a selection marker. The *G. manogstana* coding region was under the control of the *Prototheca moriformis* Amt03 promoter/5'UTR (SEQ ID NO: 89) and *C. vulgaris* nitrate reductase 3'UTR. The *G. manogstana* native transit peptide was also replaced with the transit peptide from *C. protothecoides* stearoyl desaturase (SEQ ID NO: 49) and the cDNA sequence of the thioesterase with the replaced transit peptide is listed as SEQ ID NO: 147. The entire *Garcinia mangostana* expression cassette was termed pSZ1452 and transformed into a *Prototheca moriformis* genetic background. Positive clones were screened on plates with sucrose as the sole carbon source. A subset of the positive clones were selected and grown under lipid production conditions and lipid profiles were determined using direct transesterification methods as described above. The lipid profiles of the selected clones are summarized in Table 18 below.

TABLE 18

Lipid profiles of *Garcinia mangostana* C16:0-preferring thioesterase transgenic *Prototheca* cells.

| Strain | C10:0 | C12:0 | C14:0 | C16:0 | C18:0 | C18:1 | C18:2 |
|---|---|---|---|---|---|---|---|
| wildtype | 0.01 | 0.03 | 1.17 | 25.86 | 2.84 | 58.33 | 9.16 |
| pSZ1452 clone A | 0.02 | 0.07 | 5.52 | 62.77 | 4.36 | 18.99 | 6.29 |
| pSZ1452 clone B | 0.02 | 0.08 | 5.69 | 61.66 | 4.76 | 19.28 | 6.54 |
| pSZ1452 clone C | 0.01 | 0.05 | 3.44 | 57.97 | 4.21 | 24.76 | 7.38 |

The results show that transformants with the *G. mangostana* thioesterase transgene have significantly impacted C16:0 fatty acid levels and to a lesser extent, impacted C14:0 and C18:0 fatty acid levels, along with a sharp decrease in C18:1 fatty acid levels as compared to wildtype.

A C16:0-preferring thioesterase from *Cuphea hookeriana* was introduced into a *Prototheca moriformis* UTEX 1435 genetic background. Two expression constructs were created, one with the native *Cuphea hookeriana* C16-preferring thioesterase transit peptide sequence, termed pSZ1417, and a second where the native transit peptide sequence was replaced with the transit peptide from *C. protothecoides* stearoyl-ACP desaturase (SEQ ID NO: 49), termed pSZ1462. The coding sequence of the *C. hookeriana* thioesterase with the native transit peptide is listed as SEQ ID NO: 149 and the coding sequence of the *C. hookeriana* thioesterase with the replaced transit peptide is listed as SEQ ID NO: 160. Both expression constructs contained a 5' (SEQ ID NO: 82) and 3' (SEQ ID NO: 84) homologous recombination targeting sequences (flanking the construct) to the 6S genomic region for integration into the nuclear genome and a *S. cerevisiae* suc2 sucrose invertase coding region under the control of *C. reinhardtii* β-tubulin promoter/5'UTR and *Chlorella vulgaris* nitrate reductase 3' UTR. This *S. cerevisiae* suc2 expression cassette is listed as SEQ ID NO: 159 and served as a selection marker. In both constructs, the *C. hookeriana* coding region was under the control of the *Prototheca moriformis* Amt03 promoter/5'UTR (SEQ ID NO: 89) and *C. vulgaris* nitrate reductase 3'UTR. Both constructs were transformed into a *Prototheca moriformis* genetic background and positive clones were screened on plates with sucrose as the sole carbon source. A subset of the positive clones were selected and grown under lipid production conditions and lipid profiles were determined using direct transesterification methods as described above. The lipid profiles of the selected clones are summarized in Table 19 below.

TABLE 19

Lipid profiles of *Cuphea hookeriana* C16:0 preferring thioesterase transgenic *Prototheca* cells.

| Strain | C10:0 | C12:0 | C14:0 | C16:0 | C18:0 | C18:1 | C18:2 |
|---|---|---|---|---|---|---|---|
| wildtype | 0.01 | 0.03 | 1.17 | 25.86 | 2.84 | 58.33 | 9.16 |
| pSZ1417 clone A | 0.02 | 0.06 | 4.21 | 55.29 | 2.59 | 26.87 | 9.02 |
| pSZ1417 clone B | 0.02 | 0.06 | 4.12 | 54.57 | 2.31 | 26.43 | 10.45 |
| pSZ1417 clone C | 0.01 | 0.05 | 3.59 | 53.18 | 2.60 | 29.02 | 9.48 |
| pSZ1462 clone A | 0.02 | 0.11 | 10.62 | 67.42 | 2.18 | 12.95 | 5.13 |
| pSZ1462 clone B | 0.03 | 0.11 | 8.88 | 66.83 | 2.30 | 15.32 | 5.16 |
| pSZ1462 clone C | 0.03 | 0.11 | 9.28 | 66.65 | 2.27 | 15.19 | 5.14 |
| pSZ1462 clone D | 0.02 | 0.09 | 8.30 | 66.36 | 2.27 | 16.52 | 5.01 |

The results show that transformants with either of the *Cuphea hookeriana* C16:0-preferring thioesterase constructs have significantly impacted C16:0 fatty acid levels and to a lesser extent an impacted C14:0 fatty acid levels, along with a sharp decrease in C18:1 fatty acid levels as compared to wildtype. The difference in transit peptides in the two constructs may account for the increased C16:0 fatty acid levels in the pSZ1462 transformants compared to the pSZ1417 transformants.

Two C16:0-preferring thioesterases from *Elaeis guiniensis* (African oil palm) corresponding to the amino acid sequence in Genbank Accession Nos. AAD422220.2 (SEQ ID NO: 152) and ABD83939 (SEQ ID NO: 162), termed *E. guiniensis* palmitoyl-ACP thioesterase and *E. guiniensis* palmitoyl-ACP thioesterase PATE, respectively, was introduced into a *Prototheca moriformis* UTEX 1435 genetic background. The codon-optimized cDNA sequences and amino acid sequences are listed in the Sequence Listing as specified above. The two thioesterases share a significant level of amino acid identity (over 94%), but their respective roles in the African oil palm plant is still unclear. The construct encoding the *E. guiniensis* palmitoyl-ACP thioesterase was termed pSZ1437, and the construct encoding the *E. guiniensis* palmitoyl-ACP thioesterase PATE was termed pSZ1436. Both expression constructs contained a 5' (SEQ ID NO: 82) and 3' (SEQ ID NO: 84) homologous recombination targeting sequences (flanking the construct) to the 6S genomic region for integration into the nuclear genome and a *S. cerevisiae* suc2 sucrose invertase coding region under the control of *C. reinhardtii* β-tubulin promoter/5'UTR and *Chlorella vulgaris* nitrate reductase 3' UTR. This *S. cerevisiae* suc2 expression cassette is listed as SEQ ID NO: 159 and served as a selection marker. In both constructs, the *E. guiniensis* thioesterase coding region was under the control of the *Prototheca moriformis* Amt03 promoter/5'UTR (SEQ ID NO: 89) and *C. vulgaris* nitrate reductase 3'UTR. Both constructs were transformed into a *Prototheca moriformis* genetic background and positive clones were screened on plates with sucrose as the sole carbon source. A subset of the positive clones were selected and grown under lipid production conditions and lipid profiles were determined using direct transesterification methods as described above. The lipid profiles of the selected clones are summarized in Table 20 below.

TABLE 20

Lipid profiles of *Elaeis guiniensis* C16:0 preferring thioesterase transgenic *Prototheca* cells.

| Strain | C10:0 | C12:0 | C14:0 | C16:0 | C18:0 | C18:1 | C18:2 |
|---|---|---|---|---|---|---|---|
| wildtype | 0.01 | 0.03 | 1.17 | 25.86 | 2.84 | 58.33 | 9.16 |
| pSZ1437 clone A | 0.02 | 0.07 | 3.82 | 55.86 | 3.12 | 24.47 | 10.48 |
| pSZ1437 clone B | 0.02 | 0.05 | 3.01 | 53.23 | 3.47 | 28.70 | 9.26 |
| pSZ1437 clone C | 0.02 | 0.06 | 3.33 | 53.20 | 3.30 | 26.64 | 11.19 |
| pSZ1437 clone D | 0.02 | 0.05 | 3.08 | 52.88 | 3.60 | 27.94 | 10.16 |
| pSA1437 clone E | 0.02 | 0.05 | 3.01 | 52.84 | 3.48 | 28.46 | 9.87 |
| pSZ1436 clone A | 0.01 | 0.04 | 1.48 | 29.54 | 3.33 | 52.26 | 10.58 |
| pSZ1436 clone B | 0.01 | 0.04 | 1.48 | 29.43 | 3.33 | 52.11 | 10.76 |

TABLE 20-continued

Lipid profiles of *Elaeis guiniensis* C16:0 preferring thioesterase transgenic *Prototheca* cells.

| Strain | C10:0 | C12:0 | C14:0 | C16:0 | C18:0 | C18:1 | C18:2 |
|---|---|---|---|---|---|---|---|
| pSZ1436 clone C | 0.01 | 0.04 | 1.50 | 29.25 | 3.38 | 52.07 | 10.89 |
| pSZ1436 clone D | 0.01 | 0.04 | 1.51 | 29.18 | 3.41 | 51.80 | 11.17 |
| pSZ1436 clone E | 0.01 | 0.04 | 1.54 | 29.14 | 3.56 | 51.43 | 11.42 |

The *E. guiniensis* C16:0-preferring thioesterase encoded by pSZ 1437 had a significant impact on the C16:0 fatty acid levels, to a lesser extend, the C14:0 fatty acid levels, and a sharp decrease in the C18:1 fatty acid levels when compared to wildtype. Surprising, the *E. guiniensis* C16:0-preferring thioesterase PATE encoded by pSZ1436, despite the significant level of amino acid identity to the thioesterase encoded by pSZ1436, had relatively little activity with regard to C16:0 or C14:0 fatty acid levels.

A C18:0-preferring thioesterase from *Brassica napus* was introduced into a *Prototheca moriformis* UTEX 1435 genetic background, and the codon-optimized cDNA sequences and amino acid sequences are listed in the Sequence Listing as specified above. The expression construct contained a 5' (SEQ ID NO: 82) and 3' (SEQ ID NO: 84) homologous recombination targeting sequences (flanking the construct) to the 6S genomic region for integration into the nuclear genome and a *S. cerevisiae* suc2 sucrose invertase coding region under the control of *C. reinhardtii* β-tubulin promoter/5'UTR and *Chlorella vulgaris* nitrate reductase 3' UTR. This *S. cerevisiae* suc2 expression cassette is listed as SEQ ID NO: 159 and served as a selection marker. The *B. napus* coding region was under the control of the *Prototheca moriformis* Amt03 promoter/5'UTR (SEQ ID NO: 89) and *C. vulgaris* nitrate reductase 3'UTR. The entire *Brassica napus* expression cassette was termed pSZ1358 and transformed into a *Prototheca moriformis* genetic background. Positive clones were screened on plates with sucrose as the sole carbon source. A subset of the positive clones were selected and grown under lipid production conditions and lipid profiles were determined using direct transesterification methods as described above. The lipid profiles of the selected clones are summarized in Table 21 below.

The results show that transformants with the *Brassica napus* C18:0-preferring thioesterase transgene have significantly impacted C18:0 fatty acid levels and to a lesser extent, impacted C16:0 fatty acid levels, along with a sharp decrease in C18:1 fatty acid levels as compared to wildtype.

A fatty acyl-ACP thioesterase from *Ricinus communis* was introduced into a *Prototheca moriformis* UTEX 1435 genetic background, and the codon-optimized cDNA sequences and amino acid sequences are listed in the Sequence Listing as specified above. The expression construct contained a 5' (SEQ ID NO: 82) and 3' (SEQ ID NO: 84) homologous recombination targeting sequences (flanking the construct) to the 6S genomic region for integration into the nuclear genome and a *S. cerevisiae* suc2 sucrose invertase coding region under the control of *C. reinhardtii* β-tubulin promoter/5'UTR and *Chlorella vulgaris* nitrate reductase 3' UTR. This *S. cerevisiae* suc2 expression cassette is listed as SEQ ID NO: 159 and served as a selection marker. The *R. communis* coding region was under the control of the *Prototheca moriformis* Amt03 promoter/5'UTR (SEQ ID NO: 89) and *C. vulgaris* nitrate reductase 3'UTR. The *Ricinus communis* native transit peptide was also replaced with the transit peptide from *C. protothecoides* stearoyl desaturase (SEQ ID NO: 49) and the cDNA sequence of the thioesterase with the replaced transit peptide is listed as SEQ ID NO: 155. The entire *Ricinus communis* expression cassette was termed pSZ1375 and transformed into a *Prototheca moriformis* genetic background. Positive clones were screened on plates with sucrose as the sole carbon source. A subset of the positive clones were selected and grown under lipid production conditions and lipid profiles were determined using direct transesterification methods as described above. The lipid profiles of the selected clones are summarized in Table 22 below.

TABLE 21

Lipid profiles of *Brassica napus* C18:0-preferring thioesterase transgenic *Prototheca* cells.

| Strain | C10:0 | C12:0 | C14:0 | C16:0 | C18:0 | C18:1 | C18:2 |
|---|---|---|---|---|---|---|---|
| wildtype | 0.00 | 0.04 | 1.18 | 25.44 | 3.42 | 57.97 | 6.98 |
| pSZ1358 clone A | 0.07 | 0.31 | 1.51 | 33.27 | 27.26 | 27.37 | 7.50 |
| pSZ1358 clone B | 0.07 | 0.33 | 1.60 | 34.73 | 26.71 | 26.52 | 7.32 |

TABLE 22

Lipid profiles of *Ricinus communis* ACP- thioesterase transgenic *Prototheca* cells.

| Strain | C10:0 | C12:0 | C14:0 | C16:0 | C18:0 | C18:1 | C18:2 |
|---|---|---|---|---|---|---|---|
| wildtype | 0.01 | 0.03 | 0.98 | 24.65 | 3.68 | 62.48 | 6.26 |
| pSZ1375 clone A | 0.01 | 0.03 | 0.91 | 18.34 | 2.55 | 67.93 | 8.35 |
| pSZ1375 clone B | 0.01 | 0.03 | 0.97 | 18.51 | 2.47 | 67.83 | 8.25 |
| pSZ1375 clone C | 0.01 | 0.03 | 0.93 | 18.65 | 2.84 | 67.58 | 7.90 |
| pSZ1375 clone D | 0.01 | 0.03 | 0.92 | 18.90 | 2.30 | 67.48 | 8.37 |

The results show that transformants with the *Ricinus communis* thioesterase transgene have impacted levels of C16:0 fatty acids and to a lesser extent, C18:0 fatty acid levels. Also, there was a concomitant increase in the C18:1 fatty acid level when compared to the wildtype level.

Example 4

Transformation of *Prototheca* with Multiple Exogenous Heterologous Thioesterase Genes Microalgae strain *Prototheca moriformis* (UTEX 1435) was transformed using the above disclosed methods to express multiple thioesterases in a single clone. The expression of multiple thioesterases in a single clone allows the microalgae to produce oils with fatty acid profiles completely different from those elaborated when any single thioesterase is expressed alone (as demonstrated in the preceding Examples). *Prototheca moriformis* (UTEX 1435) was first transformed with the *Cinnamomum camphora* thioesterase (a C14 preferring thioesterase) along with a sucrose invertase gene, the suc2 from *S. cerevisiae* (selection was the ability to grow on sucrose) using homologous recombination. The DNA used for this homologous recombination construct is from the KE858 region of *Prototheca moriformis* genomic DNA as described in the Section III above. The relevant portion of this construct is listed in the Sequence Listing as SEQ ID NO: 51. Positive clones were screened on sucrose-containing plates. A positive clone was then re-transformed with one of three cassettes, each encoding resistance to the antibiotic G418 as well as an additional thioesterase: (1) thioesterase gene from *Cuphea hookeriana* (C8-10 preferring), SEQ ID NO: 52; (2) thioesterase gene from *Umbellularia californica* (C12 preferring), SEQ ID NO: 53; or thioesterase from *Ulmus americana* (broad; C10-C16 preferring), SEQ ID NO: 54. Included in the Sequence Listing is the sequence of the relevant portion of each construct. Clones expressing both thioesterase genes were screened on sucrose containing medium with 50 μg/ml G418. Positive clones were selected and growth and lipid profile were assayed. Table 23 summarizes the lipid profile of representative positive clones (expressed in Area %).

TABLE 23

Lipid profiles of *Prototheca moriformis* transformed with multiple thioesterases.

| Fatty Acid | UTEX 1435 | UTEX 1435 + C. camphora TE genetic background | | | |
|---|---|---|---|---|---|
| | | + C. camphora TE | + C. hookeriana TE | + U. californica TE | + U. americana TE |
| C8:0 | 0 | 0 | 0.19 | 0 | 0.06 |
| C10:0 | 0.02 | 0.02 | 2.16 | 0.07 | 1.87 |

TABLE 23-continued

Lipid profiles of *Prototheca moriformis* transformed with multiple thioesterases.

| Fatty Acid | UTEX 1435 | UTEX 1435 + C. camphora TE genetic background | | | |
|---|---|---|---|---|---|
| | | + C. camphora TE | + C. hookeriana TE | + U. californica TE | + U. americana TE |
| C12:0 | 0.05 | 0.66 | 0.53 | 13.55 | 1.61 |
| C14:0 | 1.65 | 10.52 | 7.64 | 8.0 | 14.58 |
| C16:0 | 28.0 | 22.56 | 22.31 | 19.98 | 29.53 |
| C18:0 | 2.9 | 6.67 | 3.23 | 2.24 | 2.93 |
| C18:1 | 53.8 | 47.78 | 48.54 | 42.55 | 37.3 |
| C18:2 | 10.95 | 12.3 | 11.76 | 10.13 | 8.9 |
| C18:3 α | 0.8 | 0.93 | 0.91 | 0.91 | 0.76 |
| Total saturates (Area %) | 32.62 | 40.43 | 36.06 | 43.84 | 50.58 |

Additionally, a double thioesterase clone with *C. camphora* and *U. californica* thioesterases was grown in 2% sucrose containing medium with 50 mg/L G418 at 22° C. The fatty acid profile obtained from this strain under these growth conditions was: C8:0 (0); C10:0 (0.10); C12:0 (31.03); C14:0 (7.47); C16:0 (15.20); C18:0 (0.90); C18:1 (30.60); C18:2 (12.44); and C18:3a (1.38), with a total saturates of 54.7.

Double thioesterase clones with two homologous recombination constructs (one targeting the 6S region and the other targeting the KE858 region) containing the *C. camphora* thioestease were produced. A positive representative clone had a fatty acid profile of: 0% C8:0; 0.06% C10:0; 5.91% C12:0; 43.27% C14:0; 19.63% C16:0; 0.87% C18:0; 13.96% C18:1; and 13.78% C18:2, with a total saturates at 69.74%. This clone had a C12-C14 level at over 49%, which is over 37 times the C12-C14 level in wildtype cells.

The above data shows that multiple thioesterases can be successfully co-expressed in microalgae. The co-expression of multiple thioesterases results in altered fatty acid profiles that differ significantly not only from the wild type strain, but also from the fatty acid profile obtained by the expression of any one of the individual thioesterases. The expression of multiple thioesterases with overlapping chain length specificity can result in cumulative increases in those specific fatty acids.

The expression of heterologous thioesterases (either alone or in combination) in *Prototheca moriformis* not only alters the fatty acid/lipid profiles in the host strain, but when compared to oils currently available from a variety of seed crops (Table 5), these profiles are of truly unique oils found in no other currently available system. Not only do the transgenic strains show significant differences from the untransformed wildtype strain, they have remarkably different profiles from any of the commercial oils that are shown in Table 5. As an example, both coconut and palm kernel oils have levels of C8-C10 fatty acids ranging from 5.5-17%. Transgenic strain expressing the *C. palustris* C8-preferring thioesterase or the *C. hookeriana* C10-preferring thioesterase accumulates anywhere from 3.66 to 8.65%, respectively. These C8-C10 fatty acid levels are similar to coconut oil and palm kernel, however, the transgenic algal strains lack the significantly higher C12:0 fatty acids, and they have extremely high C16:0 (23% in transgenics versus 11-16% in coconut or palm kernel oil, respectively and/or 18:1 (50-57% in transgenics versus 8-19% in coconut or palm kernel oil, respectively.

Generation of Laurate and Myristate Rich Oils in Strain UTEX1435 by the Expression of *Cuphea wrightii* Thioesterases:

Seeds of *Cuphea wrightii* have been shown to accumulate oil containing over 25% C10:0 and over 65% C12:0 fatty acids. Two FatB thioesterases, CwFatB1 (Gen Bank Accession no. U56103) and CwFatB2 (Gen Bank Accession no. U56104), have been cloned from *Cuphea wrightii* (as described in Leonard et al, *Plant Mol. Biol.* 34(4):669-79 (1997)) and expressed in *Arabidopsis thaliana* (as described in Leonard et al, *Plant J.* 13(5):621-8 (1998)). Fatty acid profiles of *A. thaliana* transgenic lines expressing CwFatB1 and CwFatB2 show increased C12:0 fatty acid species up to 16% to 25% (Leonard et al, 1998, supra). Here we demonstrate the ability to generate laurate and myristate rich oils by expressing the *Cuphea wrightii* thioesterases, CwFatB1 and CwFatB2, in strain UTEX1435. In the example described here, transgenic strains expressing CwFatB1 and CwFatB2 were generated using the transformation methodology described before.

Amino acid sequences of CwFatB1 and CwFatB2 are shown below with the predicted chloroplast targeting sequences underlined. These primary amino acid sequences were used to synthesize the corresponding genes for transformation constructs. The nucleotide sequences of the two genes were optimized for expression in strain UTEX 1435 utilizing its preferred codon usage as previously described.

```
CwFatB1 (U56103):
                                         (SEQ ID NO: 186)
MVAAAASSAFFSVPTPGTSPKPGKFGNWPSSLSVPFKPDNGGFVKANASA

HPKANGSAVNLKSGSLETPPRSFINQLPDLSMLLSKITTVFGAAEKQWKR

PGMLVEPFGVDRIFQDGVFFRQSFSIRSYEIGVDRTASIETLMNIFQETS

LNHCKSIGLLNDGFGRTPEMCKRDLIWVVTKIQVEVNRYPTWGDTIEVNT

WVSESGKNGMGRDWLISDCRTGEILIRATSVWAMMNQNTRRLSKFPYEVR

QEIAPHFVDSAPVIEDDRKLHKLDVKTGDSIRDGLTPRWNDLDVNQHVNN

VKYIGWILKSVPIEVFETQELCGVTLEYRRECGRDSVLESVTTMDPAKEG

DRCVYQHLLRLEDGADITIGRTEWRPKNAGANGAISSGKTSNGNSVS

CwFatB2 (U56104):
                                         (SEQ ID NO: 187)
MVVAAAASSAFFPVPAPRPTPKPGKFGNWPSSLSQPFKPKSNPNGRFQVK

ANVSPHPKANGSAVSLKSGSLNTLEDPPSSPPPRTFLNQLPDWSRLRTAI

TTVFVAAEKQFTRLDRKSKRPDMLVDWFGSETIVQDGLVFRERFSIRSYE

IGADRTASIETLMNHLQDTSLNHCKSVGLLNDGEGRTPEMCTRDLIWVLT

KMQIVVNRYPTWGDTVEINSWFSQSGKIGMGREWLISDCNTGEILVRATS

AWAMMNQKTRRFSKLPCEVRQEIAPHFVDAPPVIEDNDRKLHKFDVKTGD

SICKGLTPGWNDFDVNQHVSNVKYIGWILESMPTEVLETQELCSLTLEYR

RECGRESVVESVTSMNPSKVGDRSQYQHLLRLEDGADIMKGRTEWRPKNA

GTNRAIST
```

Transformation of UTEX1435 with *C. wrightii* Thioesterases:

In this example, UTEX 1435 strain was used as the recipient strain into which cassettes expressing the *C. wrightii* FatB1 and FatB2 thioesterases were introduced. The transformation constructs contain a cassette allowing for selection on sucrose (the *Saccharomyces cerevesiae* suc2 gene) along with the thioesterases. Cells were transformed as previously described using biolistics. Cells were transformed directly on media containing 2% sucrose. Transformation constructs were made such that the expression of the thioesterases were driven either by the *C. reinhardtii* B-tubulin promoter or by the endogenous UTEX 1435 Amt3 promoter.

Additional versions of the thioesterase cassettes were made in which the native, higher plant transit peptides were replaced by algal transit peptides. The transit peptides used in these constructs are designated as follows: TP1 encodes a transit peptide for Stearoyl ACP desaturase derived from UTEX250; TP2 encodes a transit peptide for Stearoyl ACP desaturase from derived from UTEX 1435; TP3 encodes a transit peptide of delta 12 Fatty Acid desaturase derived from UTEX 1435; and TP4 encodes a transit peptide of isopentenyl diphosphate synthase derived from UTEX 1435. The constructs used in this example are listed in Table 24 below.

TABLE 24

TE constructs.

| Construct | Description |
|---|---|
| Const. 1 | 6S-CrbTub_suc2_nr::CrbTub_CwFatB1_nr-6S |
| Const. 2 | 6S-CrbTub_suc2_nr::CrbTub_CwFatB2_nr-6S |
| Const. 3 | 6S-CrbTub_suc2_nr::Amt3_CwFatB1_nr-6S |
| Const. 4 | 6S-CrbTub_suc2_nr::Amt3_CwFatB2_nr-6S |
| Const. 5 | 6S-CrbTub_suc2_nr::CrbTub_TP1-CwFatB1_nr-6S |
| Const. 6 | 6S-CrbTub_suc2_nr::CrbTub_TP2-CwFatB1_nr-6S |
| Const. 7 | 6S-CrbTub_suc2_nr::CrbTub_TP3-CwFatB1_nr-6S |
| Const. 8 | 6S-CrbTub_suc2_nr::CrbTub_TP4-CwFatB1_nr-6S |
| Const. 9 | 6S-CrbTub_suc2_nr::CrbTub_TP1-CwFatB2_nr-6S |
| Const. 10 | 6S-CrbTub_suc2_nr::CrbTub_TP2-CwFatB2_nr-6S |
| Const. 11 | 6S-CrbTub_suc2_nr::CrbTub_TP3-CwFatB2_nr-6S |
| Const. 12 | 6S-CrbTub_suc2_nr::CrbTub_TP4-CwFatB2_nr-6S |

Transforming DNA Expressing suc2 and the *C. wrightii* FatB1 Thioesterase (Const. 1):

The sequence of the transforming construct, 6S-CrbTub_suc2_nr::CrbTub_CwFatB1_nr-6S, designated as Const. 1 is given below. Relevant restriction sites are indicated in lowercase, bold and underlining and are 5'-3' SapI, KpnI, AscI, MfeI, BamHI, EcoRI, SpeI, AscI, XhoI, SacI and SapI, respectively. SapI sites delimit the 5' and 3' ends of the transforming DNA. Underlined sequences at the 5' and 3' flanks of the construct represent genomic DNA from UTEX1435 that permit targeted integration of the transforming DNA via homologous recombination (6S region). Proceeding in the 5' to 3' direction, the *C. reinhardtii* B-tubulin promoter driving the expression of *S. cerevisiae* suc2 gene (encoding sucrose hydrolyzing activity thereby permitting the strain to grow on sucrose) is indicated by lowercase, boxed text. The initiator ATG and terminator TGA for suc2 are indicated by uppercase, bold italics while the coding region is indicated in lowercase italics. The *Chlorella vulgaris* nitrate reductase 3' UTR is indicated by lowercase bold

*text followed by a spacer region. The* C. reinhardtii *B-tubulin promoter, driving expression of the* C. wrightii *TE (Cw-FatB1) is indicated by boxed text. The initiator ATG and terminator TGA of the thioesterase (CwFatB1) are indicated in uppercase, bold italicized text while the remainder of the coding region is indicated in lowercase italics. The predicted plastid targeting sequence of the thioesterase lies between the initiator ATG and the AscI site in the sequence. The *C. vulgaris* nitrate reductase 3'UTR is indicated by bold text.

Construct 1:

(SEQ ID NO: 188)

gctcttcgccgccgccactcctgctcgagcgcgcccgcgcgtgcgccgccagcgccttggccttttcgccgcgctcgtgcgcgtcg ctgatgtccatcaccaggtccatgaggtctgccttgcgccggctgagccactgcttcgtccgggcggccaagaggagcatgaggga ggactcctggtccagggtcctgacgtggtcgcggctctgggagcgggccagcatcatctggctctgccgcaccgaggccgcctcca actggtcctccagcagccgcagtcgccgccgaccctggcagaggaagacaggtgaggggggtatgaattgtacagaacaaccacg agccttgtctaggcagaatccctaccagtcatggctttacctggatgacggcctgcgaacagctgtccagcgaccctcgctgccgccg cttctcccgcacgcttctttccagcaccgtgatggcgcgagccagcgccgcacgctggcgctgcgcttcgccgatctgaggacagtc ggggaactctgatcagtctaaacccccttgcgcgttagtgttgccatcctttgcagaccggtgagagccgacttgttgtgcgccacccc ccacaccacctcctcccagaccaattctgtcacctttttggcgaaggcatcggcctcggcctgcagagaggacagcagtgcccagcc gctgggggttggcggatgcacgctcaggtaccctttcttgcgctatgacacttccagcaaaaggtagggcgggctgcgagacggctt cccggcgctgcatgcaacaccgatgatgcttcgacccccccgaagctccttcggggctgcatgggcgctccgatgccgctccagggc gagcgctgtttaaatagccaggcccccgattgcaaagacattatagcgagctaccaaagcatattcaaacacctagatcactaccactt ctacacaggccactcgagcttgtgatcgcactccgctaagggggcgcctcttcccttcgtttcagtcacaacccgcaaacggcgcgcc atatca*ATG**ctgctgcaggccttcctgttcctgctggccggcttcgccgccaagatcagcgcctccatgacgaacgagacgtccg*

*accgcccccctggtgcacttcacccccaacaagggctggatgaacgaccccaacggcctgtggtacgacgagaaggacgccaa*

*gtggcacctgtacttccagtacaacccgaacgacaccgtctgggggacgcccttgttctggggccacgccacgtccgacgacctg*

*accaactgggaggaccagcccatcgccatcgccccgaagcgcaacgactccggcgccttctccggctccatggtggtggactac*

*aacaacacctccggcttcttcaacgacaccatcgacccgcgccagcgctgcgtggccatctggacctacaacaccccggagtcc*

*gaggagcagtacatctcctacagcctggacggcggctacaccttcaccgagtaccagaagaaccccgtgctggccgccaactcc*

*acccagttccgcgacccgaaggtcttctggtacgagccctcccagaagtggatcatgaccgcggccaagtcccaggactacaag*

*atcgagatctactcctccgacgacctgaagtcctggaagctggagtccgcgttcgccaacgagggcttcctcggctaccagtacg*

*agtgccccggcctgatcgaggtccccaccgagcaggaccccagcaagtcctactgggtgatgttcatctccatcaaccccggcgc*

*cccggccggcggctccttcaaccagtacttcgtcggcagcttcaacggcacccacttcgaggccttcgacaaccagtcccgcgtg*

*gtggacttcggcaaggactactacgccctgcagaccttcttcaacaccgacccgacctacgggagcgccctgggcatcgcgtgg*

*gcctccaactgggagtactccgccttcgtgcccaccaacccctggcgctcctccatgtccctcgtgcgcaagttctccctcaacacc*

*gagtaccaggccaacccggagacggagctgatcaacctgaaggccgagccgatcctgaacatcagcaacgccggcccctgg*

*agccggttcgccaccaacaccacgttgacgaaggccaacagctacaacgtcgacctgtccaacagcaccggcaccctggagtt*

*cgagctggtgtacgccgtcaacaccacccagacgatctccaagtccgtgttcgcggacctctccctctggttcaagggcctggagg*

*accccgaggagtacctccgcatgggcttcgaggtgtccgcgtcctccttcttcctggaccgcgggaacagcaaggtgaagttcgtg*

*aaggagaacccctacttcaccaaccgcatgagcgtgaacaaccagcccttcaagagcgagaacgacctgtcctactacaaggt*

*gtacggcttgctggaccagaacatcctggagctgtacttcaacgacggcgacgtcgtgtccaccaacacctacttcatgaccaccg*

*ggaacgccctgggctccgtgaacatgacgacgggggtggacaacctgttctacatcgacaagttccaggtgcgcgaggtcaag*

*TGA*caattggcagcagcagctcggatagtatcgacacactctggacgctggtcgtgtgatggactgttgccgccacacttgct

-continued gccttgacctgtgaatatccctgccgcttttatcaaacagcctcagtgtgtttgatcttgtgtgtacgcgcttttgcgagttgctagc tgcttgtgctatttgcgaataccaccccagcatccccttccctcgtttcatatcgcttgcatcccaaccgcaacttatctacgctg tcctgctatccctcagcgctgctcctgctcctgctcactgccctcgcacagccttggtttgggctccgcctgtattctcctggtact gcaacctgtaaaccagcactgcaatgctgatgcacgggaagtagtgggatgggaacacaaatggaggatcccgcgtctcgaa cagagcgcgcagaggaacgctgaaggtctcgcctctgtcgcacctcagcgcggcatacaccacaataaccacctgacgaatgcgct tggttcttcgtccattagcgaagcgtccggttcacacacgtgccacgttggcgaggtggcaggtgacaatgatcggtggagctgatggt cgaaacgttcacagcctagggatatcgaattc⌐ctttcttgcgctatgacacttccagcaaaaggtagggcgggctgcgagacggctt¬

⌐cccggcgctgcatgcaacaccgatgatgcttcgaccccccgaagctccttcggggctgcatgggcgctccgatgccgctccagggc¬

⌐gagcgctgtttaaatagccaggcccccgattgcaaagacattatagcgagctaccaaagccatattcaaacacctagatcactaccact¬

⌐tctacacaggccactcgagcttgtgatcgcactccgctaaggggggcgcctcttcctcttcgtttcagtcacaacccgcaaac⌐actagtA

*TG*gtggccgccgccgccagcagcgccttcttcagcgtgcccaccccggcaccagccccaagcccggcaagttcggcaactg gcccagcagcctgagcgtgcccttcaagcccgacaacggcggcttccacgtgaaggccaacgccagcgcccacggcgcgcc cccaaggccaacggcagcgccgtgaacctgaagtccggcagcctggagaccccccccgcagcttcatcaaccagctgcccg acctgagcatgctgctgagcaagatcaccaccgtgttcggcgccgccgagaagcagtggaagcgccccggcatgctggtggag cccttcggcgtggaccgcatcttccaggacggcgtgttcttccgccagagcttcagcatccgcagctacgagatcggcgtggaccg caccgccagcatcgagaccctgatgaacatcttccaggagaccagcctgaaccactgcaagagcatcggcctgctgaacgacg gcttcggccgcaccccgagatgtgcaagcgcgacctgatctgggtggtgaccaagatccaggtggaggtgaaccgctaccca cctggggcgacaccatcgaggtgaacacctgggtgagcgagagcggcaagaacggcatgggccgcgactggctgatcagcg actgccgcaccggcgagatcctgatccgcgccaccagcgtgtgggccatgatgaaccagaacacccgccgcctgagcaagttc ccctacgaggtgcgccaggagatcgcccccccacttcgtggacagcgcccccgtgatcgaggacgaccgcaagctgcacaagct ggacgtgaagaccggcgacagcatccgcgacggcctgaccccccgctggaacgacctggacgtgaaccagcacgtgaacaa cgtgaagtacatcggctggattctgaagtccgtgcccatcgaggtgttcgagacccaggagctgtgcggcgtgaccctggagtac cgccgcgagtgcggccgcgacagcgtgctggagagcgtgaccaccatggaccccgccaaggagggcgaccgctgcgtgtacc agcacctgctgcgcctggaggacggcgccgacatcaccatcggccgcaccgagtggcgccccaagaacgccggcgccaacg gcgccatcagcagcggcaagaccagcaacggcaacagcgtgagc*TGA*ttaattaactcgaggcagcagcagctcggatagt atcgacacactctggacgctggtcgtgtgatggactgttgccgccacacttgctgccttgacctgtgaatatccctgccgctttta tcaaacagcctcagtgtgtttgatcttgtgtgtacgcgcttttgcgagttgctagctgcttgtgctatttgcgaataccaccccag catccccttccctcgtttcatatcgcttgcatcccaaccgcaacttatctacgctgtcctgctatccctcagcgctgctcctgctcct gctcactgccctcgcacagccttggtttgggctccgcctgtattctcctggtactgcaacctgtaaaccagcactgcaatgctg atgcacgggaagtagtgggatgggaacacaaatggaaagcttgagctcttgattccagaaggagagaccagagccatcattc tcagcctcgataacctccaaagccgctctaattgtggaggggggttcgaatttaaaagcttggaatgttggttcgtgcgtctggaacaagc -continued ccagacttgagctcactgggaaaaggaccatcagctccaaaaaacttgccgctcaaaccgcgtacctctgcatcgcgcaatctgccct gttgaaatcgccaccacattcatattgtgacgcttgagcagtctgtaattgcctcagaatgtggaatcatctgcccctgtgcgagccat gccaggcatgtcgcgggcgaggacaccc gccactcgtacagcagaccattatgctacctcacaatagttcataacagtgaccatatttc gctaccgaaatccccgaccggatcccaccaccccc gcgatgggaagaatctctccccgggatgtgggccaccaccagcacaacct gctggcccaggcgagcgtcaaaccataccacacaaatatccttggcatcggccctgaattccttctgccgctctgctacccggtgcttct gtccgaagcagg ggttgctagggatcgctccgagtccgcaaaccct tgtcgcgtggcggggcttgttcgagcttgaagagc

Transforming DNA Expressing suc2 and the *C. wrightii* FatB2 Thioesterase (Const. 2):

The transforming construct, 6S-CrbTub_suc2_nr::CrbTub_CwFatB2_nr-6S, designated as Const. 2, was generated by replacing the CwFatB1 gene from Const. 1 with the codon optimized CwFatB2 gene utilizing the SpeI and AscI restriction sites, which are indicated in lowercase, in bold and underlined. The initiator ATG and terminator TGA of the thioesterase (CwFatB2) are indicated in uppercase, bold italicized text while the remainder of the coding region is indicated in lowercase italics. The predicted plastid targeting sequence of the thioesterase lies between the initiator ATG and the AscI site in the sequence.

Construct 2 (Partial):

(SEQ ID NO: 189)

actagt*ATG*gtggtggccgccgccgccagcagcgccttcttccccgtgcccgcccccgcccacccccaagcccggcaagtt cggcaactggcccagcagcctgagccagcccttcaagcccaagagcaacccc aacggccgcttccaggtgaaggccaacgtg agccccaccggcgcgcccccaaggccaacggcagcgccgtgagcctgaagtccggcagcctgaacaccctggaggacccc cccagcagccccccccccgcaccttcctgaaccagctgcccgactggagccgcctgcgcaccgccatcaccaccgtgttcgtg gccgccgagaagcagttcacccgcctggaccgcaagagcaagcgccccgacatgctggtggactggttcggcagcgagacca tcgtgcaggacggcctggtgttccgcgagcgcttcagcatccgcagctacgagatcggcgccgaccgcaccgccagcatcgag accctgatgaaccacctgcaggacaccagcctgaaccactgcaagagcgtgggcctgctgaacgacggcttcggccgcacccc cgagatgtgcacccgcgacctgatctgggtgctgaccaagatgcagatcgtggtgaaccgctaccccacctggggcgacaccgt ggagatcaacagctggttcagccagagcggcaagatcggcatgggccgcgagtggctgatcagcgactgcaacaccggcgag atcctggtgcgcgccaccagcgcctgggccatgatgaaccagaagacccgccgcttcagcaagctgccctgcgaggtgcgcca ggagatcgccccccacttcgtggacgcccccccgtgatcgaggacaacgaccgcaagctgcacaagttcgacgtgaagaccg gcgacagcatctgcaagggcctgaccccggctggaacgacttcgacgtgaaccagcacgtgagcaacgtgaagtacatcggc tggattctggagagcatgcccaccgaggtgctggagacccaggagctgtgcagcctgacc ctggagtaccgccgcgagtgcgg ccgcgagagcgtggtggagagcgtgaccagcatgaacccc agcaaggtgggcgaccgcagccagtaccagcacctgctgcg cctggaggacggcgccgacatcatgaagggccgcaccgagtggcgccccaagaacgccggcaccaaccgcgccatcagcac c*TGA*ttaattactcgag

Transforming DNA Expressing suc2 and the *C. wrightii* FatB1 and FatB2 Thioesterases Driven by amt3 Promoter (Const. 3 & 4):

The transforming constructs 6S-CrbTub_suc2_nr::Amt3_CwFatB1_nr-6S, designated as Const. 3, and 6S-CrbTub_suc2_nr::Amt3_CwFatB2_nr-6S, designated as Const. 4 were generated by replacing the CrbTub promoter driving the thioesterases, from Const. 1 and Const. 2, with the Amt3 promoter derived from UTEX1435 as an EcoRI and SpeI restriction fragment, indicated below in lowercase, bold and underlined. The Amt3 promoter region is indicated by lowercase boxed text.

Constructs 3 and 4 (partial):
(SEQ ID NO: 190)

gaattcggcgctatgacacaccagcaaaaggtagggcgggctgcgagacggcacccggcgctgcatgcaacaccgatgatgct cgacccccgaagctccttcggggctgcatgggcgctccgatgccgctccagggcgagcgctgtttaaatagccaggccccgatt gcaaagacattatagcgagctaccaaagccatattcaaacacctagatcactaccacttctacacaggccactcgagcttgtgatcgca ctccgctaaggggggcgcctcttcctcttcgtttcagtcggccgacaggacgcgcgtcaaaggtgctggtcgtgtatgccctggccggc aggtcgttgctgctgctggttagtgattccgcaaccctgattttggcgtcttattttggcgtggcaaacgctggcgcccgcgagccgggc cggcggcgatgcggtgcccacggctgccggaatccaagggaggcaagagcgcccgggtcagttgaagggctttacgcgcaagg tacagccgctcctgcaaggctgcgtggtggaattggacgtgcaggtcctgctgaagttcctccaccgcctcaccagcggacaaagca ccggtgtatcaggtccgtgtcatccactctaaagagctcgactacgacctactgatggccctagattcttcatcaaaaacgcctgagaca cttgcccaggattgaaactccctgaagggaccaccaggggccctgagttgttccttcccccgtggcgagctgccagccaggctgta cctgtgatcgaggctggcgggaaaataggcttcgtgtgctcaggtcatgggaggtgcaggacagctcatgaaacgccaacaatcgc acaattcatgtcaagctaatcagctatttcctcttcacgagctgtaattgtcccaaaattctggtctaccgggggtgatccttcgtgtacgg gcccttccctcaaccctaggtatgcgcgcatgcggtcgccgcgcaactcgcgcgagggccgagggtttgggacgggccgtcccga aatgcagttgcacccggatgcgtggcaccttttttgcgataatttatgcaatggactgctctgcaaaattctggctctgtcgccaaccctag gatcagcggcgtaggatttcgtaatcattcgtcctgatgggagctaccgactaccctaatatcagcccgactgcctgacgccagcgtc gatcagcggcgtaggatttcgtaatcattcgtcctgatgggagctaccgactaccctaatatcagcccgactgcctgacgccagcgtc cactttgtgcacacattccattcgtgcccaagacatttcattgtggtgcgaagcgtccccagttacgctcacctgtttcccgacctccttac tgttctgtcgacagagcgggcccacaggccggtcgcagccactagt

Transforming DNA Expressing *C. wrightii* FatB1 Thioesterase Under the Control of Algal Transit Peptides:

The transforming constructs 6S-CrbTub_suc2_nr::CrbTub_TP1-CwFatB1_

Transforming DNA Expressing *C. wrightii* FatB2 Thioesterase Under the Control of Algal Transit Peptides:

The transforming constructs 6S-CrbTub_suc2_nr::CrbTub_TP1-CwFatB2_nr-6S, designated as Const. 9; construct 6S-CrbTub_suc2_nr::CrbTub_TP2-CwFatB2_nr-6S, designated as Const. 10; construct 6S-CrbTub_suc2_nr::CrbTub_TP3-CwFatB2_nr-6S, designated as Const. 11 and construct 6S-CrbTub_suc2_nr::CrbTub_TP4-CwFatB2_nr-6S, designated as Const. 12 were generated by replacing the native transit peptide of CwFatB2 from Const. 2 with the corresponding algal transit peptides shown above as SpeI and AscI restriction fragments, which are indicated in lowercase, bold and underlining. The algal transit peptide sequence lies between the initiator ATG and the AscI site in the sequences above.

Fatty Acid Profiles Resulting from Strains Expressing *Cuphea wrightii* Thioesterases:

Strains transformed with the constructs described above were grown under conditions allowing for the production of oil as previously described. Wild type UTEX 1435 was grown on glucose while all the transgenic lines generated by transformation of UTEX 1435 were grown on sucrose. For each construct tested, four transformants were analyzed for impacts on fatty acid profiles. The fatty acid profiles for transgenic strains are shown in Tables 25 to 28 below.

Transgenic lines of *A. thaliana* expressing CwFatB1 and CwFatB2 (Table 25) show a significant impact on the accumulation of C16:0 fatty acids along with accumulation of C14:0 and C12:0 fatty acids (from Leonard et al, 1998, supra).

As can be seen from Table 26, transgenic UTEX 1435 lines expressing CwFatB1 (Const. 1 & Const. 3) with the native, higher plant transit peptide, show an impact primarily on C14:0 fatty acid accumulation and to a lesser extent on C12:0 fatty acid accumulation. The transgenic UTEX1435 lines expressing CwFatB2 (Const. 2 & Const. 4) with the native higher plant transit peptide, show significant impact on C12:0 and C14:0 fatty acid accumulation, with the impact on C12:0 being higher than on C14:0. A comparison between the two promoters, CrbTub (Const. 1 & Const. 2) and Amt3 (Const. 3 & Const. 4) demonstrates that transgenic lines expressing CwFatB1 & CwFatB2 show significantly higher impacts on C10:0, C12:0, C14:0 and C16:0 fatty acids when driven by the Amt3 promoter.

Analysis of transgenic lines wherein the expression of CwFatB1 thioesterase is driven by the four different algal chloroplast targeting sequences (Const. 5, 6, 7, and 8) shows that any of the algal transit peptides targets the thioesterase to the plastid more efficiently than the native higher plant transit peptide (compare the C12:0 and C14:0 levels in constructs 5-8, Table 27, with those in construct 1, Table 26). Further analysis of these transgenic lines reveals that of the four algal transit peptides TP2 (UTEX1435 Stearoyl ACP Desaturase chloroplast targeting sequence) and TP3 (UTEX 1435 Delta 12 Fatty Acid Desaturase chloroplast targeting sequence) show a greater impact on C12:0 and C14:0 accumulation. It appears that these two transit peptides (TP1 & TP2) are better at targeting the CwFatB1 to the plastid in UTEX 1435.

Analysis of transgenic lines wherein the expression of CwFatB2 thioesterase is driven by the four different algal chloroplast targeting sequences (Const. 9, 10, 11, and 12) demonstrates that only one of the algal transit peptides gives superior performance to the native, higher plant transit peptide, namely TP-1, as can be seen higher impact on the C12:0 and C14:0 fatty acids (compare Const 9 to Const. 2).

The impact of these *C. wrightii* thioesterases when expressed in UTEX 1435 is significantly different than when expressed in *Arabidopsis*. Transgenic lines of *A. thaliana* expressing CwFatB1 and CwFatB2 (Table 25) show a significant impact on the accumulation of C16:0 fatty acids along with accumulation of C14:0 and C12:0 fatty acids. CwFatB1 and CwFatB2 expressed in UTEX 1435, however, do not show the same level of impact on C16:0 fatty acids. The C12:C14 ratios in all the UTEX 1435 transgenic lines, expressing CwFatB1, and some expressing CwFatB2 (Const. 10, 11, 12) are similar to the *A. thaliana* transgenic lines expressing this thioesterase (Table 29). However, the UTEX 1435 transgenic lines show a significantly lower C14:C16 ratio compared to the *A. thaliana* transgenic lines (Table 29). The C12:C14 and C14:C16 ratios in the UTEX 1435 transgenic lines generated with Const. 2, 4, 9 are significantly different than the *A. thaliana* transgenic lines expressing the same thioesterase (Table 29). Thus, the expression of CwFatB1 and CwFatB2, in UTEX 1435 generated an oil profile that is significantly different than that generated in transgenic lines of *Arabidopsis* expressing the same thioesterases. The oil profile in these UTEX 1435 transgenic lines is also distinctly different from that in wild type UTEX 1435.

Finally, the modified oils produced by the transgenic lines described in this Example are also significantly different than the laurate rich oils generated in transgenic UTEX 1435 lines expressing a C12:0 specific thioesterase from *Umbellularia californica* (described previously).

Taken together, these data indicate that: (1) expression of *Cuphea wrightii* thioesterases in UTEX 1435 has a significant impact on fatty acid profiles and generates unique oils; (2) the expression of CwFatB1 thioesterase in the strain UTEX 1435 results in the generation of an oil rich in myristate; (3) the expression of CwFatB2 thioestease in UTEX 1435 results in the generation of an oil rich in both laurate and myristate; and (4) the expression of CwFatB1 and FatB2 in algae generates profiles quite distinct from those generated in a model higher plant system, both in terms of the absolute levels of mid-chain fatty acids produced and in their relative ratios to one another.

TABLE 25

Fatty acid profiles (expressed as area %) in UTEX1435, *A. thaliana* wild type (Ath) and *A. thaliana* transgenic lines expressing CwFatB1 (CwFatB1-Ath) and CwFatB2 (CwFatB2-Ath) thioesterases.

| Sample ID | C10:0 | C12:0 | C14:0 | C16:0 | C18:0 | C18:1 | C18:2 | C18:3 | C20:0 | C20:1 |
|---|---|---|---|---|---|---|---|---|---|---|
| UTEX1435 | 0.01 | 0.03 | 0.93 | 23.83 | 3.27 | 61.85 | 8.08 | 0.53 | 0.31 | 0.08 |
| Ath | 0.00 | 0.00 | 0.00 | 8.40 | 3.80 | 13.00 | 29.20 | 20.10 | 2.40 | 19.30 |
| Cw FatB1-Ath | 0.00 | 7.10 | 24.40 | 22.80 | 3.30 | 4.50 | 14.10 | 12.90 | 3.00 | 6.00 |
| Cw FatB2-Ath | 4.40 | 16.40 | 15.30 | 18.10 | 3.90 | 4.90 | 13.90 | 13.60 | 2.80 | 5.70 |

TABLE 26

Fatty acid profiles (expressed as area %) in UTEX1435 transgenic lines expressing Const.1; Const.2; Const.3 and Const.4.

| Construct | Sample ID | C10:0 | C12:0 | C14:0 | C16:0 | C18:0 | C18:1 | C18:2 | C18:3 | C20:0 | C20:1 |
|---|---|---|---|---|---|---|---|---|---|---|---|
| Const.1 | 1A | 0.01 | 0.43 | 3.17 | 19.84 | 1.66 | 60.34 | 12.38 | 0.45 | 0.23 | 0.02 |
|  | 1B | 0.01 | 0.52 | 3.45 | 19.81 | 2.03 | 60.65 | 11.42 | 0.42 | 0.26 | 0.02 |
|  | 1C | 0.01 | 0.59 | 3.62 | 20.53 | 2.24 | 59.64 | 11.29 | 0.42 | 0.26 | 0.02 |
|  | 1D | 0.01 | 0.67 | 3.92 | 21.97 | 1.96 | 58.62 | 10.82 | 0.44 | 0.24 | 0.02 |
| Const.2 | 2A | 0.63 | 7.47 | 5.64 | 18.74 | 2.36 | 52.11 | 10.98 | 0.49 | 0.28 | 0.02 |
|  | 2B | 0.82 | 7.77 | 5.83 | 19.84 | 2.62 | 51.98 | 9.24 | 0.50 | 0.24 | 0.02 |
|  | 2C | 0.82 | 9.57 | 6.31 | 18.64 | 1.66 | 50.89 | 10.42 | 0.43 | 0.21 | 0.01 |
|  | 2D | 0.90 | 10.04 | 7.11 | 17.99 | 2.34 | 49.03 | 10.63 | 0.47 | 0.26 | 0.02 |
| Const.3 | 3A | 0.04 | 2.85 | 12.09 | 28.04 | 2.69 | 39.02 | 12.35 | 1.05 | 0.25 | 0.05 |
|  | 3B | 0.03 | 2.90 | 13.39 | 28.01 | 2.02 | 41.47 | 10.01 | 0.71 | 0.21 | 0.05 |
|  | 3C | 0.04 | 3.30 | 14.10 | 27.91 | 2.09 | 40.50 | 9.92 | 0.71 | 0.21 | 0.04 |
|  | 3D | 0.04 | 3.71 | 15.10 | 27.88 | 2.01 | 39.56 | 9.62 | 0.68 | 0.21 | 0.06 |
| Const.4 | 4A | 1.43 | 11.78 | 8.87 | 19.67 | 2.04 | 43.80 | 10.28 | 0.77 | 0.21 | 0.06 |
|  | 4B | 1.39 | 12.26 | 9.29 | 16.88 | 1.48 | 44.20 | 12.18 | 0.86 | 0.19 | 0.08 |
|  | 4C | 1.73 | 13.42 | 9.55 | 18.93 | 2.05 | 41.92 | 10.30 | 0.81 | 0.21 | 0.04 |
|  | 4D | 1.82 | 14.18 | 10.07 | 18.56 | 1.93 | 41.22 | 10.21 | 0.78 | 0.19 | 0.05 |

TABLE 27

Fatty acid profiles (expressed as area %) in UTEX1435 transgenic lines expressing Const.5; Const.6; Const.7 and Const.8.

| Construct | Sample ID | C10:0 | C12.0 | C14:0 | C16:0 | C18:0 | C18:1 | C18:2 | C18:3 | C20:0 | C20:1 |
|---|---|---|---|---|---|---|---|---|---|---|---|
| Const.5 | 5A | 0.02 | 0.62 | 4.33 | 23.30 | 2.00 | 57.43 | 10.00 | 0.59 | 0.26 | 0.09 |
|  | 5B | 0.02 | 0.78 | 5.11 | 25.06 | 2.45 | 55.65 | 8.76 | 0.58 | 0.26 | 0.07 |
|  | 5C | 0.02 | 1.20 | 7.41 | 24.48 | 1.87 | 52.65 | 10.18 | 0.60 | 0.24 | 0.08 |
|  | 5D | 0.02 | 1.33 | 7.56 | 24.55 | 1.87 | 52.59 | 9.90 | 0.54 | 0.26 | 0.09 |
| Const.6 | 6A | 0.02 | 0.56 | 4.01 | 24.23 | 2.50 | 57.04 | 9.32 | 0.57 | 0.28 | 0.08 |
|  | 6B | 0.02 | 0.69 | 4.97 | 23.41 | 1.92 | 55.59 | 10.98 | 0.61 | 0.25 | 0.09 |
|  | 6C | 0.02 | 1.14 | 7.07 | 25.05 | 2.11 | 53.23 | 9.23 | 0.60 | 0.23 | 0.07 |
|  | 6D | 0.05 | 5.10 | 19.88 | 21.43 | 1.29 | 40.40 | 9.89 | 0.63 | 0.20 | 0.08 |
| Const.7 | 7A | 0.02 | 1.39 | 8.36 | 25.39 | 2.00 | 51.37 | 9.37 | 0.55 | 0.22 | 0.07 |
|  | 7B | 0.02 | 1.42 | 7.59 | 24.77 | 2.12 | 53.17 | 8.87 | 0.47 | 0.23 | 0.08 |
|  | 7C | 0.02 | 1.49 | 7.82 | 24.87 | 2.10 | 52.45 | 9.14 | 0.53 | 0.24 | 0.08 |
|  | 7D | 0.03 | 2.15 | 11.01 | 25.64 | 1.85 | 47.35 | 9.92 | 0.51 | 0.23 | 0.08 |
| Const.8 | 8A | 0.02 | 0.81 | 5.28 | 23.38 | 2.03 | 56.10 | 10.14 | 0.54 | 0.26 | 0.09 |
|  | 8B | 0.02 | 0.88 | 5.77 | 23.58 | 1.91 | 54.91 | 10.58 | 0.57 | 0.24 | 0.09 |
|  | 8C | 0.02 | 1.27 | 7.57 | 24.28 | 1.93 | 52.95 | 9.88 | 0.54 | 0.24 | 0.08 |
|  | 8D | 0.02 | 1.43 | 5.02 | 21.52 | 2.63 | 58.32 | 9.14 | 0.52 | 0.28 | 0.09 |

TABLE 28

Fatty acid profiles (expressed as area %) in UTEX1435 transgenic lines expressing Const.9; Const.10; Const.11 and Const.12.

| Construct | Sample ID | C10:0 | C12:0 | C14:0 | C16:0 | C18:0 | C18:1 | C18:2 | C18:3 | C20:0 | C20:1 |
|---|---|---|---|---|---|---|---|---|---|---|---|
| Const.9 | 9A | 0.90 | 8.96 | 6.59 | 19.24 | 2.20 | 51.17 | 8.91 | 0.55 | 0.24 | 0.08 |
|  | 9B | 1.00 | 9.07 | 6.31 | 19.55 | 2.21 | 51.43 | 8.47 | 0.53 | 0.25 | 0.07 |
|  | 9C | 1.06 | 12.08 | 8.79 | 17.57 | 1.70 | 46.54 | 10.29 | 0.58 | 0.21 | 0.07 |
|  | 9D | 1.27 | 13.05 | 8.67 | 17.70 | 1.78 | 46.28 | 9.38 | 0.57 | 0.22 | 0.07 |
| Const.10 | 10A | 0.52 | 5.55 | 5.00 | 20.60 | 2.03 | 53.35 | 10.66 | 0.71 | 0.24 | 0.07 |
|  | 10B | 0.53 | 5.76 | 5.16 | 20.63 | 1.92 | 52.80 | 10.90 | 0.67 | 0.23 | 0.06 |
|  | 10C | 0.47 | 5.86 | 5.20 | 19.54 | 1.89 | 53.34 | 11.41 | 0.62 | 0.26 | 0.06 |
|  | 10D | 0.87 | 8.59 | 6.85 | 19.65 | 1.98 | 49.65 | 10.21 | 0.69 | 0.23 | 0.08 |
| Const.11 | 11A | 0.21 | 2.48 | 2.85 | 20.80 | 1.99 | 57.69 | 11.53 | 0.70 | 0.27 | 0.11 |
|  | 11B | 0.22 | 2.80 | 3.01 | 21.30 | 1.89 | 57.28 | 11.07 | 0.66 | 0.27 | 0.11 |
|  | 11C | 0.29 | 3.22 | 3.38 | 21.33 | 2.09 | 56.92 | 10.42 | 0.71 | 0.25 | 0.05 |
|  | 11D | 0.28 | 4.01 | 4.01 | 18.79 | 1.69 | 56.08 | 12.73 | 0.64 | 0.26 | 0.09 |
| Const.12 | 12A | 0.65 | 6.01 | 5.43 | 21.50 | 2.10 | 52.70 | 9.28 | 0.75 | 0.24 | 0.10 |
|  | 12B | 0.52 | 6.58 | 5.62 | 18.71 | 1.78 | 52.59 | 11.84 | 0.66 | 0.26 | 0.11 |
|  | 12C | 0.78 | 8.60 | 6.88 | 19.01 | 1.69 | 50.40 | 10.45 | 0.69 | 0.23 | 0.08 |
|  | 12D | 0.72 | 8.75 | 7.07 | 17.74 | 1.54 | 50.57 | 11.29 | 0.68 | 0.22 | 0.10 |

TABLE 29

Ratios of C12:C14 and C14:C16 in UTEX 1435 transgenic lines expressing CwFatB1 (Const. 1, 3, 5, 6, 7, 8) and CwFatB2 (Const. 2, 4, 9, 10, 11, 12) along with *A. thaliana* transgenic lines expressing CwFatB1 (CwFatB1-Ath) and CwFatB2 (CwFatB2-Ath).

| Sample ID | Average 12:14 ratio | Average 14:16 ratio |
|---|---|---|
| Cw Fat B1-Ath | 0.291 | 1.070 |
| Const. 1 | 0.155 | 0.172 |
| Const. 3 | 0.233 | 0.489 |
| Const. 5 | 0.250 | 0.250 |
| Const. 6 | 0.174 | 0.397 |
| Const. 7 | 0.185 | 0.345 |
| Const. 8 | 0.190 | 0.254 |
| Cw Fat B2-Ath | 1.072 | 0.845 |
| Const. 2 | 1.396 | 0.332 |
| Const. 4 | 1.365 | 0.512 |
| Const. 9 | 1.419 | 0.414 |
| Const. 10 | 1.152 | 0.277 |
| Const. 11 | 0.938 | 0.163 |
| Const. 12 | 1.191 | 0.328 |

Example 5

Identification of Endogenous Nitrogen-Dependent *Prototheca* Promoters

A. Identification and Characterization of Endogenous Nitrogen-Dependent Promoters.

A cDNA library was generated from *Prototheca moriformis* (UTEX 1435) using standard techniques. The *Prototheca moriformis* cells were grown for 48 hours under nitrogen replete conditions. Then a 5% innoculum (v/v) was then transferred to low nitrogen and the cells were harvested every 24 hours for seven days. After about 24 hours in culture, the nitrogen supply in the media was completely depleted. The collected samples were immediately frozen using dry ice and isopropanol. Total RNA was subsequently isolated from the frozen cell pellet samples and a portion from each sample was held in reserve for RT-PCR studies. The rest of the total RNA harvested from the samples was subjected to polyA selection. Equimolar amounts of polyA selected RNA from each condition was then pooled and used to generate a cDNA library in vector pcDNA 3.0 (Invitrogen). Roughly 1200 clones were randomly picked from the resulting pooled cDNA library and subjected to sequencing on both strands. Approximately 68 different cDNAs were selected from among these 1200 sequences and used to design cDNA-specific primers for use in real-time RT-PCR studies.

RNA isolated from the cell pellet samples that were held in reserve was used as substrate in the real time RT-PCR studies using the cDNA-specific primer sets generated above. This reserved RNA was converted into cDNA and used as substrate for RT-PCR for each of the 68 gene specific primer sets. Threshold cycle or $C_T$ numbers were used to indicate relative transcript abundance for each of the 68 cDNAs within each RNA sample collected throughout the time course. cDNAs showing significant increase (greater than three fold) between nitrogen replete and nitrogen-depleted conditions were flagged as potential genes whose expression was up-regulated by nitrogen depletion. As discussed in the specification, nitrogen depletion/limitation is a known inducer of lipogenesis in oleaginous microorganisms.

In order to identify putative promoters/5'UTR sequences from the cDNAs whose expression was upregulated during nitrogen depletion/limitation, total DNA was isolated from *Prototheca moriformis* (UTEX 1435) grown under nitrogen replete conditions and were then subjected to sequencing using 454 sequencing technology (Roche). cDNAs flagged as being up-regulated by the RT-PCR results above were compared using BLAST against assembled contigs arising from the 454 genomic sequencing reads. The 5' ends of cDNAs were mapped to specific contigs, and where possible, greater than 500 bp of 5' flanking DNA was used to putatively identify promoters/UTRs. The presence of promoters/5'UTR were subsequently confirmed and cloned using PCR amplification of genomic DNA. Individual cDNA 5' ends were used to design 3' primers and 5' end of the 454 contig assemblies were used to design 5' gene-specific primers.

As a first screen, one of the putative promoter, the 5'UTR/promoter isolated from Aat2 (Ammonium transporter, SEQ ID NO: 63), was cloned into the *Cinnamomum camphora* C14 thioesterase construct with the *Chlorella protothecoides* stearoyl ACP desaturase transit peptide, replacing the *C. sorokinana* glutamate dehydrogenase promoter. This construct is listed as SEQ ID NO: 81. To test the putative promoter, the thioesterase construct is transformed into *Prototheca moriformis* cells to confirm actual promoter activity by screening for an increase in C14/C12 fatty acids under low/no nitrogen conditions, using the methods described above. Similar testing of the putative nitrogen-regulated promoters isolated from the cDNA/genomic screen can be done using the same methods.

Other putative nitrogen-regulated promoters/5'UTRs that were isolated from the cDNA/genomic screen were:

| Promoter/5'UTR | SEQ ID NO. | Fold increased |
|---|---|---|
| FatB/A promoter/5'UTR | SEQ ID NO: 55 | n/a |
| NRAMP metal transporter promoter/5'UTR | SEQ ID NO: 56 | 9.65 |
| Flap Flagellar-associated protein promoter/5'UTR | SEQ ID NO: 57 | 4.92 |
| SulfRed Sulfite reductase promoter/5'UTR | SEQ ID NO: 58 | 10.91 |
| SugT Sugar transporter promoter/5'UTR | SEQ ID NO: 59 | 17.35 |
| Amt03-Ammonium transporter 03 promoter/5'UTR | SEQ ID NO: 60 | 10.1 |
| Amt02-Ammonium transporter 02 promoter/5'UTR | SEQ ID NO: 61 | 10.76 |
| Aat01-Amino acid transporter 01 promoter/5'UTR | SEQ ID NO: 62 | 6.21 |
| Aat02-Amino acid transporter 02 promoter/5'UTR | SEQ ID NO: 63 | 6.5 |
| Aat03-Amino acid transporter 03 promoter/5'UTR | SEQ ID NO: 64 | 7.87 |
| Aat04-Amino acid transporter 04 promoter/5'UTR | SEQ ID NO: 65 | 10.95 |
| Aat05-Amino acid transporter 05 promoter/5'UTR | SEQ ID NO: 66 | 6.71 |

Fold increase refers to the fold increase in cDNA abundance after 24 hours of culture in low nitrogen medium.

To gain further insight into potential regulation of these putative promoter/5'UTRs, eight of the sequences were selected for further testing: (1) FatB/A; (2) SulfRed Sulfite reductase; (3) SugT Sugar transporter; (4) Amt02-Ammonium transporter 02; (5) Aat01-Amino acid transporter 01; (6) Aat03-Amino acid transporter 03; (7) Aat04-Amino acid transporter 04; and (8) Aat05-Amino acid transporter 05. Higher resolution transcriptome analysis utilizing Illumina sequencing reads were carried out on RNA isolated from *Prototheca moriformis* cells various time points: T0 (seed); 20 hours; 32 hours; 48 hours; 62 hours; and 114 hours post inoculation from seed. The medium at T0 (seed) was nitrogen replete, while at the time points 20 hours and longer, the medium contained little to no nitrogen. Assembled transcript contigs generated from RNA isolated from each of the time points were then blasted independently with each of the eight previously identified transcripts. The results are summarized in Table 30 below.

TABLE 30

Transcriptome expression profiles for eight putative promoters/5'UTRs.

| cDNA | | TS | T20 | T32 | T48 | T62 | T114 |
|---|---|---|---|---|---|---|---|
| aa trans_01 | absolute | 98 | 96 | 321 | 745 | 927 | 1300 |
| | relative | 1 | 0.98 | 3.28 | 7.61 | 9.47 | 13.28 |
| aa trans_03 | absolute | 7 | 21 | 51 | 137 | 102 | 109 |
| | relative | 1 | 2.95 | 7.2 | 19.42 | 14.47 | 15.45 |
| aa trans_04 | absolute | 1 | 6 | 25 | 90 | 131 | 160 |
| | relative | 1 | 5.16 | 21.29 | 74.97 | 109.35 | 133.31 |
| aa trans_05 | absolute | 109 | 88 | 123 | 210 | 214 | 273 |
| | relative | 1 | 0.81 | 1.13 | 1.93 | 1.97 | 2.51 |
| ammon trans_02 | absolute | 683 | 173 | 402 | 991 | 1413 | 1397 |
| | relative | 1 | 0.25 | 0.59 | 1.45 | 2.07 | 2.04 |
| fatA/B-1_cDNA | absolute | 13 | 36 | 654 | 617 | 544 | 749 |
| | relative | 1 | 2.8 | 51.57 | 48.65 | 42.9 | 59.1 |
| sug trans_01 | absolute | 25 | 25 | 106 | 261 | 266 | 251 |
| | relative | 1 | 1 | 4.22 | 10.4 | 10.63 | 10 |
| sulfite reductase_01 | absolute | 634 | 238 | 138 | 145 | 163 | 155 |
| | relative | 1 | 0.38 | 0.22 | 0.22 | 0.26 | 0.24 |

From the above-summarized results, several of the transcripts show increased accumulation over time, although interestingly, the sulfite reductase mRNA shows a distinct decrease in mRNA accumulation over time.

These eight putative promoter/5'UTR regions were cloned upstream of the C. camphora thioesterase coding region with its native transit peptide taken out and substituted with the transit peptide from Chlorella protothecoides (UTEX 250) stearoyl ACP desaturase. Each putative promoter/5'UTR region construct was introduced into Prototheca moriformis UTEX 1435 via homologous recombination using DNA from the 6S genomic sequence. Also contained within the construct is a suc2 sucrose invertase gene from S. cerevisiae for selection of positive clones on sucrose containing media/plates. The cDNA sequence for the relevant portions of the construct for Aat01 is listed in the Sequence Listing as SEQ ID NO: 67. For the other constructs, the same backbone was use, the only variable was the putative promoter/5'UTR sequence. An additional control transgenic strain was generated in which the C. reinhardtii beta tubulin promoter was used to drive expression of the C. camphora thioesterase gene. This promoter have shown to drive constitutive expression of the gene of interest, and thus provides a useful control against which to measure expression of the same thioesterase message when driven by the various putative N-regulated promoters/5'UTRs tested.

Once the transgenic clones were generated, three separate experiments were carried out. The first two experiments assess the potential nitrogen regulatability of all eight putative promoters by measuring steady state thioesterase mRNA levels via RT-PCR, fatty acid profiles and ammonia levels in the culture supernatants. Clones were initially grown at 28° C. with agitation (200 rpm) in nitrogen rich seed medium (1 g/L ammonium nitrate-15 mM nitrogen as ammonia, 4 g/L yeast extract) for 24 to 48 hours, at which point 20 OD units ($A_{750}$) were used to inoculate 50 ml of low nitrogen media (0.2 g/L ammonium sulfate-3 mM nitrogen as ammonia, 0.2 g/L yeast extract). Cells were sampled every 24 hours for 6 days and a sample was also collected right before switching to low nitrogen conditions. A portion of the cells from each sample was then used for total RNA extraction using Trizol reagent (according to manufacturer's suggested methods). Ammonia assays revealed that ammonia levels in the supernatants fell below the limits of detection (~100 µM) after 24 hours in low nitrogen medium.

For real-time RT-PCR, all RNA levels were normalized to levels of an internal control RNA expressed in Prototheca moriformis (UTEX 1435) for each time point. The internal control RNA, termed cd189, is a product of the ARG9 gene which encodes N-acetyl ornithine aminotransferase. Primers sets used for real-time RT-PCR in these experiments were:

| Gene specific to | Primer sequence 5'-3' | SEQ ID NO: |
|---|---|---|
| C. camphora TE forward | TACCCCGCCTGGGGCGACAC | SEQ ID NO: 68 |
| C. camphora TE reverse | CTTGCTCAGGCGGCGGGTGC | SEQ ID NO: 69 |
| cd189 forward | CCGGATCTCGGCCAGGGCTA | SEQ ID NO: 70 |
| cd189 reverse | TCGATGTCGTGCACCGTCGC | SEQ ID NO: 71 |

Lipid profiles from each of the transformants from each time point were also generated and compared to the RT-PCR results. Based on the ammonia levels, RT-PCR results and changes in C12-C14 fatty acid levels, it was concluded that the Amino acid transporter 01 (Aat-01), Amino acid transporter 04 (Aat-04), and Ammonium transporter 02 (Amt-02) sequences do contain a functional nitrogen-regulatable promoter/5'UTR.

From the RT-PCR results, Aat-01 demonstrated the ability to drive steady state C. camphora thioesterase mRNA levels up to four times higher than control (C. reinhardtii beta tubulin promoter). The mRNA levels also correlated with nitrogen limitation and a marked increase in C12-C14 fatty acid levels. These results demonstrate that the 5'UTR associated with the Aat-01 promoter is likely more efficient at driving protein synthesis under lipid biosynthesis than the control *C. reinhardtii* promoter. Like the Aat-01 promoter, the Aat-04 promoter was able to drive mRNA accumulation up to five times higher than that of the *C. reinhardtii* control promoter. However, the Aat-04 promoter construct only produced a modest ability to impact C12-C14 fatty acid levels. These data demonstrate that the Aat-04 promoter is clearly regulatable by nitrogen depletion, but the UTR associated with the promoter likely functions poorly as a translational enhancer. Finally, the Amt-02 promoter was similar to the Aat-01 promoter, in that it was able to drive mRNA accumulation up to three times higher than that of the control promoter. The mRNA levels also correlated with nitrogen limitation and a marked increase in C12-C14 fatty acid levels. Taken together, all three of these promoters were demonstrated to be nitrogen-regulated.

B. Further Characterization of the Ammonium Transporter 3 (amt03) Promoter and Expression of Various Thioesterases.

As described above, partial cDNAs termed ammonium transporter 02 and 03 (amt02 and amt03) were identified. Along with these two partial cDNAs, a third partial cDNA termed ammonium transporter 01 (amt01) was also identified. Alignment of the partial cDNA and the putative translated amino acid sequences were compared. Results show amt01 to be more distantly related of the three sequences, while amt02 and amt03 differ by only a single amino acid.

Promoters/5'UTRs were generated initially in silico by blasting the partial cDNA sequences against Roche 454 genomic DNA assemblies and Illumina transcriptome assemblies as described above. Transcript contigs showing identity to the cDNA encoding amt01, amt02, and amt03 were identified, however, the transcript contigs could not differentiate between the three mRNAs as the contigs contained sequences shared by all three. Roche 454 genomic DNA assemblies gave hits to amt02 and amt03 cDNA sequences and contained N-terminal protein sequences. PCR was carried out to clone the 5' flanking regions. The PCR primers used to validate the clone amt02 and amt03 promoter/UTR were:

```
Amt03 forward:
                                    (SEQ ID NO: 85)
5'-GGAGGAATTCGGCCGACAGGACGCGCGTCA-3'

Amt03 reverse:
                                    (SEQ ID NO: 86)
5'-GGAGACTAGTGGCTGCGACCGGCCTGTG-3'

Amt02 forward:
                                    (SEQ ID NO: 87)
5'-GGAGGAATTCTCACCAGCGGACAAAGCACCG-3'

Amt02 reverse:
                                    (SEQ ID NO: 88)
5'-GGAGACTAGTGGCTGCGACCGGCCTCTGG-3'
```

In both cases, the 5' and 3' primers contained useful restriction sites for the anticipated cloning into expression vectors to validate the functionality of these promoter/5'UTR regions.

Pair wise alignments between the DNAs cloned through this combined in silico and PCR-based method and the original cDNA encoding amt02 (SEQ ID NO: 61) and amt03 (SEQ ID NO: 60) were performed. Results of these alignments showed significant differences between the original cDNAs and the cloned genomic sequences, indicating that ammonium transporters likely represent a diverse gene family. Additionally, the promoter/5'UTR clone based on the combined method for amt03 was different than the original amt03 sequence, whereas the amt02 sequences were identical. Further experiments to characterize the amt03 promoter/UTR sequence (SEQ ID NO: 89) was carried out and described below.

The above identified amt03 promoter/UTR sequence (SEQ ID NO: 89) was tested by cloning this putative promoter/UTR sequence to drive the expression of four different thioesterases. The expression cassette contained upstream and downstream homologous recombination sequences to the 6S locus of the genome (SEQ ID NOs: 82 and 84, respectively). The cassette also contains a *S. cerevisiae* SUC2 sucrose invertase cDNA to enable the selection for positive clones on sucrose containing medium. The sucrose invertase expression was driven by the *C. reinhardtii* beta tubulin promoter and also contained a *C. vulgaris* nitrate reductase 3'UTR. The amt03 promoter/UTR sequence was then cloned downstream of the sucrose invertase cassette followed by in-frame thioesterase cDNA sequence from one of four thioesterase genes: (1) C14 thioesterase from *C. camphora*; (2) C12 thioesterase from *U. californica*; (3) C10-C16 thioesterase from *U. americana*; or (4) C10 thioesterase from *C. hookeriana* and also contained a *C. vulgaris* nitrate reductase 3'UTR. The C14 *C. camphora* thioesterase, C12 *U. californica* thioesterase, and the C10-C16 *U. americana* all contained the transit peptide from a *Chlorella prototheocides* stearoyl ACP desaturase. The C10 *C. hookeriana* thioesterase contained the transit peptide from a *Prototheca moriformis* delta 12 fatty acid desaturase (FAD). In all cases, the sequences were codon optimized for expression in *Prototheca moriformis*. The sequences to the foregoing thioesterase constructs are described in the Sequence Listing:

| | |
|---|---|
| amt03 promoter/UTR::*C. camphora* thioesterase construct | SEQ ID NO: 90 |
| *C. camphora* thioesterase construct | SEQ ID NO: 91 |
| *U. californica* thioesterase construct | SEQ ID NO: 92 |
| *U. americana* thioesterase construct | SEQ ID NO: 93 |
| *C. hookeriana* thioesterase construct | SEQ ID NO: 94 |

Transgenic lines were generated via biolistic transformation methods as described above in Example 2 into wild type *Prototheca moriformis* cells and selection was carried out on sucrose containing plates/medium. Positive lines were then screened for the degree to which their fatty acid profiles were altered. Four lines, one resulting from the transformation with each of the four above-described constructs, were then subjected to additional analysis. Line 76 expressed the *C. camphora* C14 thioesterase, line 37 expressed the *U. californica* C12 thioesterase, line 60 expressed the *U. americana* C10-C16 thioesterase, and line 56 expressed the *C. hookeriana* C10 thioesterase. Each line was grown for 48 hours in medium containing sucrose as the sole carbon source and samples of cells were removed at 14, 24, 36 and 48 hours (seed culture) for determination of fatty acid profile via direct transesterification to fatty acid methyl esters and subsequent analysis by GC-FID (described above) and for isolation of total RNA. At the end of 48 hours, these cells were used to inoculate cultures with no or low levels of nitrogen (containing sucrose as the sole carbon source) maintained at either pH 5.0 (citrate buffered, 0.05M final concentration) or pH 7.0 (HEPES buffered, 0.1M final concentration). Culture samples were removed at 12, 24, 72 and 108 hours (lipid production) for fatty acid profiling and isolation of total RNA Ammonia assays of these cultures revealed that ammonia levels fell below the limits of detection (ca. 100 µM) after 24 hours in low nitrogen medium.

Real-time RT-PCR assays on the mRNA levels of the thioesterases were performed on total RNA from each of the time points collected above and all mRNA levels were normalized to the levels of an internal control RNA (cd189). Primer sets used in real-time PCR are shown in Table 31 below:

TABLE 31

Primer sets for real-time PCR.

| Gene specific to | Primer sequence 5'-3' | SEQ ID NO: |
|---|---|---|
| C. camphora TE forward | TACCCCGCCTGGGGCGACAC | SEQ ID NO: 68 |
| C. camphora TE reverse | CTTGCTCAGGCGGCGGGTGC | SEQ ID NO: 69 |
| U. californica TE forward | CTGGGCGACGGCTTCGGCAC | SEQ ID NO: 95 |
| U. californica TE reverse | AAGTCGCGGCGCATGCCGTT | SEQ ID NO: 96 |
| U. americana TE forward | CCCAGCTGCTCACCTGCACC | SEQ ID NO: 97 |
| U. americana TE reverse | CACCCAAGGCCAACGGCAGCGCCGTG | SEQ ID NO: 98 |
| C. hookeriana TE forward | TACCCCGCCTGGGGCGACAC | SEQ ID NO: 99 |
| C. hookeriana TE reverse | AGCTTGGACAGGCGGCGGGT | SEQ ID NO: 100 |
| cd189 reverse | TCGATGTCGTGCACCGTCGC | SEQ ID NO: 71 |
| cd189 forward | CCGGATCTCGGCCAGGGCTA | SEQ ID NO: 70 |

The results from the fatty acid profiles at each of the time points in the seed culture phase showed very little impact from the thioesterases. With the commencement of the lipid production phase, the fatty acid profiles were significantly impacted, with the increases that are far more dramatic for the cultures maintained at pH 7.0 as compared to the cultures at pH 5.0. While the magnitude of the difference between pH 7.0 and 5.0 target fatty acid accumulation varied with each thioesterase tested, the overall effect was the same: that the cells grown at pH 5.0 showed significantly lower levels of the target fatty acids accumulated, but more than compared to control wild type cells.

Analysis of the RNA isolated from these same samples correlated very will with the fatty acid profile data, in that there was a clear impact of culture pH on the steady state mRNA levels for each of the thioesterases. Taking the fatty acid accumulation data and the mRNA data together, the pH regulation of thioesterase gene expression driven by the amt03 promoter/UTR was clearly mediated either at the level of transcription, mRNA stability or both. Additionally, it was observed that the steady state levels of *U. californica* mRNA were four logs lower as compared to the steady state levels of *C. hookeriana* mRNA. This observation is consistent with the hypothesis that the individual mRNA sequences may play a role in controlling expression. These data imply that ammonium uptake in *Prototheca moriformis* by the amt03 family of transporters is coupled directly to pH.

Additional fatty acid profile analysis was performed on twelve lines generated from the transformation of *Prototheca moriformis* cells with the construct amt03 promoter/UTR driving the expression of the *U. americana* C10-C16 thioesterase. Line 60, described above, was a part of the following analysis. Table 32 below shows the lipid profiles of three of the twelve lines that were analyzed along with the wild type control.

TABLE 32

Fatty acid profiles of transformants containing the
U. americana TE driven by the amt03 promoter/UTR.

| Area % | C8:0 | C10:0 | C12:0 | C14:0 | C16:0 | C18:0 | C18:1 | C18:2 | Total Saturates |
|---|---|---|---|---|---|---|---|---|---|
| wild type | 0.00 | 0.01 | 0.04 | 1.27 | 27.20 | 3.85 | 58.70 | 7.18 | 32.36 |
| Line 40 | 2.38 | 20.61 | 3.41 | 28.41 | 29.92 | 1.91 | 8.57 | 3.74 | 86.64 |
| Line 44 | 1.50 | 20.16 | 4.44 | 31.88 | 26.66 | 1.88 | 6.95 | 5.42 | 86.50 |
| Line 60 | 0.98 | 14.56 | 3.15 | 27.49 | 31.76 | 2.14 | 12.23 | 6.36 | 80.06 |

As shown in the table above, the levels of total saturates was increased dramatically over that of wild type with over 2.6 fold in the case of line 40 compared to wildtype (total saturates from the twelve lines analyzed ranged from about 63% to over 86%). Additionally, the *U. americana* thioesterase, when expressed at these levels, dramatically reduces the level of unsaturates, especially C18:1 and C18:2 (see lines 40 and 44), where in line 44, C18:1 levels are reduced by over 8 fold compared to the wild type. Also, the *U. americana* thioesterase (driven by the amt03 promoter) greatly increases the levels of mid-chain fatty acids. Line 44 shows C10:0-C14:0 levels at greater than 56%, approximately 42 fold higher than the levels seen in the wildtype strain and C8:0-C14:0 levels at greater than 57%. Additional strains transformed with a construct of the Amt03 promoter driving the expression of the *U. americana* thioesterase had representative lipid profile of: 0.23% C8:0; 9.64% C10:0; 2.62% C12:0; 31.52% C14:0; 37.63% C16:0; 5.34% C18:0; 7.05% C18:1; and 5.03% C18:2, with a total saturates percentage at 86.98%.

Additional lipid profiles generated from the transformation of *Prototheca moriformis* cells with the construct amt03 promoter/UTR (SEQ ID NO: 89) driving the expression of the *C. hookeriana* C10 thioesterase (SEQ ID NO: 94). Positive clones expressing this construct were selected and grown at pH 7.0 conditions. Representative lipid profile from a positive clone was: 9.87% C8:0; 23.97% C10:0; 0.46% C12:0; 1.24%

C14:0; 10.24% C16:0; 2.45% C18:0; 42.81% C18:1; and 7.32% C18:2. This clone had a C8-C10 percentage of 33.84

Taken together, the data suggest that the amt03 promoter/UTR, and other promoters like it, can be used as a tightly regulated promoter, which may be particularly useful for expressing a potentially toxic compound and strict enforcement of gene expression is required. The ability of *Prototheca moriformis* to grow under a wide range (at least pH 5.0 to 7.0) of pH regimes makes this organism particularly useful in combination with regulatory elements such as the amt03 promoter/UTR. Additionally, the lipid profile data above demonstrates the impressive ability of the amt03 promoter/UTR to drive gene expression.

Example 6

Altering the Levels of Saturated Fatty Acids in the Microalgae *Prototheca moriformis*

A. Decreasing Stearoyl ACP Desaturase and Delta 12 Fatty Acid Desaturase Expression by Gene Knock-Out Approach As part of a genomics screen using a bioinformatics based approach based on cDNAs, Illumia transcriptome and Roche 454 sequencing of genomic DNA from *Prototheca moriformis* (UTEX 1435), two specific groups of genes involved in fatty acid desaturation were identified: stearoyl ACP desaturases (SAD) and delta 12 fatty acid desaturases (412 FAD). Stearoyl ACP desaturase enzymes are part of the lipid synthesis pathway and they function to introduce double bonds into the fatty acyl chains, for example, the synthesis of C18:1 fatty acids from C18:0 fatty acids. Delta 12 fatty acid desaturases are also part of the lipid synthesis pathway and they function to introduce double bonds into already unsaturated fatty acids, for example, the synthesis of C18:2 fatty acids from C18:1 fatty acids. Southern blot analysis using probes based on the two classes of fatty acid desaturase genes identified during the bioinformatics efforts indicated that each class of desaturase genes was likely comprised of multiple family members. Additionally the genes encoding stearoyl ACP desaturases fell into two distinct families. Based on these results, three gene disruption constructs were designed to potentially disrupt multiple gene family members by targeting more highly conserved coding regions within each family of desaturase enzymes.

Three homologous recombination targeting constructs were designed using: (1) highly conserved portions of the coding sequence of delta 12 fatty acid desaturase (d12FAD) family members and (2) two constructs targeting each of the two distinct families of SAD, each with conserved regions of the coding sequences from each family. This strategy would embed a selectable marker gene (the suc2 sucrose invertase cassette from *S. cerevisiae* conferring the ability to hydrolyze sucrose) into these highly conserved coding regions (targeting multiple family members) rather than a classic gene replacement strategy where the homologous recombination would target flanking regions of the targeted gene.

All constructs were introduced into the cells by biolistic transformation using the methods described above and constructs were linearized before being shot into the cells. Transformants were selected on sucrose containing plates/media and changes in lipid profile were assayed using the above-described method. Relevant sequences from each of the three targeting constructs are listed below.

| Description | SEQ ID NO: |
|---|---|
| 5' sequence from coding region of d12FAD from targeting construct | SEQ ID NO: 72 |
| 3' sequence from coding region of d12FAD from targeting construct | SEQ ID NO: 73 |
| d12FAD targeting construct cDNA sequence | SEQ ID NO: 74 |
| 5' sequence from coding region of SAD2A | SEQ ID NO: 75 |
| 3' sequence from coding region of SAD2A | SEQ ID NO: 76 |
| SAD2A targeting construct cDNA sequence | SEQ ID NO: 77 |
| 5' sequence from coding region os SAD2B | SEQ ID NO: 78 |
| 3' sequence from coding region of SAD2B | SEQ ID NO: 79 |
| SAD2B targeting construct cDNA sequence | SEQ ID NO: 80 |

Representative positive clones from transformations with each of the constructs were picked and the lipid profiles for these clones were determined (expressed in Area %) and summarized in Table 33 below.

TABLE 33

Lipid profiles for desaturase knockouts.

| Fatty Acid | d12FAD KO | SAD2A KO | SAD2B KO | wt UTEX 1435 |
|---|---|---|---|---|
| C8:0 | 0 | 0 | 0 | 0 |
| C10:0 | 0.01 | 0.01 | 0.01 | 0.01 |
| C12:0 | 0.03 | 0.03 | 0.03 | 0.03 |
| C14:0 | 1.08 | 0.985 | 0.795 | 1.46 |
| C16:0 | 24.42 | 25.335 | 23.66 | 29.87 |
| C18:0 | 6.85 | 12.89 | 19.555 | 3.345 |
| C18:1 | 58.35 | 47.865 | 43.115 | 54.09 |
| C18:2 | 7.33 | 10.27 | 9.83 | 9.1 |
| C18:3 alpha | 0.83 | 0.86 | 1 | 0.89 |
| C20:0 | 0.48 | 0.86 | 1.175 | 0.325 |

Each of the construct had a measurable impact on the desired class of fatty acid and in all three cases C18:0 levels increased markedly, particularly with the two SAD knockouts. Further comparison of multiple clones from the SAD knockouts indicated that the SAD2B knockout lines had significantly greater reductions in C18:1 fatty acids than the C18:1 fatty acid levels observed with the SAD2A knockout lines.

Additional Δ12 fatty acid desaturase (FAD) knockouts were generated in a *Prototheca moriformis* background using the methods described above. In order to identify potential homologous of Δ12FADs, the following primers were used in order to amplify a genomic region encoding a putative FAD:

```
                                        SEQ ID NO: 101
        Primer 1    5'-TCACTTCATGCCGGCGGTCC-3'

SEQ ID NO: 102
        Primer 2    5'-GCGCTCCTGCTTGGCTCGAA-3'
```

The sequences resulting from the genomic amplification of *Prototheca moriformis* genomic DNA using the above primers were highly similar, but indicated that multiple genes or alleles of Δ12FADs exist in *Prototheca*.

Based on this result, two gene disruption constructs were designed that sought to inactivate one or more Δ12FAD genes. The strategy would to embed a sucrose invertase (suc2 from *S. cerevisiae*) cassette, thus conferring the ability to hydrolyze sucrose as a selectable marker, into highly conserved coding regions rather than use a classic gene replacement strategy. The first construct, termed pSZ1124, contained 5' and 3' genomic targeting sequences flanking a *C. reinhardtii* β-tubulin promoter driving the expression of the *S. cerevisiae* suc2 gene and a *Chlorella vulgaris* nitrate reductase 3'UTR (*S. cerevisiae* suc2 cassette). The second construct, termed pSZ1125, contained 5' and 3' genomic targeting sequences flanking a *C. reinhardtii* β-tubulin promoter driving the expression of the *S. cerevisiae* suc2 gene and a *Chlorella vulgaris* nitrate reductase 3'UTR. The relevant sequences of the constructs are listed in the Sequence Listing:

| | |
|---|---|
| pSZ1124 (FAD2B) 5' genomic targeting sequence | SEQ ID NO: 103 |
| pSZ1124 (FAD2B) 3' genomic targeting sequence | SEQ ID NO: 104 |
| *S. cerevisiae* suc2 cassette | SEQ ID NO: 105 |
| pSZ1125 (FAD2C) 5' genomic targeting sequence | SEQ ID NO: 106 |
| pSZ1125 (FAD2C) 3' genomic targeting sequence | SEQ ID NO: 107 | pSZ1124 and pSZ1125 were each introduced into a *Prototheca moriformis* background and positive clones were selected based on the ability to hydrolyze sucrose. Table 34 summarizes the lipid profiles (in Area %, generated using methods described above) obtained in two transgenic lines in which pSZ1124 and pSZ1125 targeting vectors were utilized.

the background for the further introduction of a C14-preferring fatty acyl-ACP thioesterase gene. The construct introducing the *C. camphora* C14-preferring thioesterase contained targeting sequence to the 6S genomic region (allowing for targeted integration of the transforming DNA via homologous recombination) and the expression construct contained the *C. reinhardtii* β-tubulin promoter driving the expression of the neoR gene with the *Chlorella vulgaris* nitrate reductase 3'UTR, followed by a second *C. reinhardtii* β-tubulin promoter driving the expression of a codon-optimized *C. camphora* thioesterase with a *Chlorella protothecoides* stearoyl ACP desaturase transit peptide with a second *Chlorella vulgaris* nitrate reductase 3'UTR. The 5' 6S genomic donor sequence is listed in SEQ ID NO: 82; the 3' 6S genomic donor sequence is listed in SEQ ID NO: 84; and the relevant expression construct for the *C. camphora* thioesterase is listed in SEQ ID NO: 83.

TABLE 34

Lipid profiles of Δ12 FAD knockouts

| | C10:0 | C12:0 | C14:0 | C16:0 | C16:1 | C18:0 | C18:1 | C18:2 | C18:3α |
|---|---|---|---|---|---|---|---|---|---|
| parent | 0.01 | 0.03 | 1.15 | 26.13 | 1.32 | 4.39 | 57.20 | 8.13 | 0.61 |
| FAD2B | 0.02 | 0.03 | 0.80 | 12.84 | 1.92 | 0.86 | 74.74 | 7.08 | 0.33 |
| FAD2C | 0.02 | 0.04 | 1.42 | 25.85 | 1.65 | 2.44 | 66.11 | 1.39 | 0.22 |

The transgenic containing the FAD2B (pSZ1124) construct gave a very interesting and unexpected result in lipid profile, in that the C18:2 levels, which would be expected to decrease, only decreased by about one area %. However, the C18:1 fatty acid levels increased significantly, almost exclusively at the expense of the C16:0 levels, which decreased significantly. The transgenic containing the FAD2C (pSZ1125) construct also gave a change in lipid profile: the levels of C18:2 are reduced significantly along with a corresponding increase in C18:1 levels.

Beef Tallow Mimetic

One positive clone generated from the above SAD2B knockout experiment as described above was selected to be used as Transformation was carried out using biolistic methods as described above and the cells were allowed to recover for 24 hours on plates containing 2% sucrose. After this time, the cells were re-suspended and re-plated on plates containing 2% sucrose and 50 μg/ml G418 for selection. Nine clones out of the positive clones generated were selected for lipid production and lipid profile. The nine transgenic clones (with the SAD2B KO and expressing *C. camphora* C14-preferring thioesterase) were cultured as described above and analyzed for lipid profile. The results are summarized below in Table 35. The lipid profile for tallow is also included in Table 35 below (National Research Council 1976: Fat Content and Composition of Animal Product).

TABLE 35

Lipid profile of thioesterase transformed clones.

| | C10:0 | C12:0 | C14:0 | C16:0 | C16:1 | C18:0 | C18:1 | C18:2 | C18:3 | C20 |
|---|---|---|---|---|---|---|---|---|---|---|
| SAD2BKO *C. camphora* TE clone 1 | 0.01 | 0.33 | 6.13 | 24.24 | 0.19 | 11.08 | 42.03 | 13.45 | 0.98 | 0.73 |
| SAD2BKO *C. camphora* TE clone 2 | 0.01 | 0.16 | 3.42 | 23.80 | 0.40 | 9.40 | 50.62 | 10.2 | 0.62 | 0.70 |
| SAD2BKO *C. camphora* TE clone 3 | 0.01 | 0.20 | 4.21 | 25.69 | 0.40 | 7.79 | 50.51 | 9.37 | 0.66 | 0.63 |
| SAD2BKO *C. camphora* TE clone 4 | 0.01 | 0.21 | 4.29 | 23.57 | 0.31 | 9.44 | 50.07 | 10.07 | 0.70 | 0.70 |
| SAD2BKO *C. camphora* TE clone 5 | 0.01 | 0.18 | 3.87 | 24.42 | 0.32 | 9.24 | 49.75 | 10.17 | 0.71 | 0.71 |
| SAD2BKO *C. camphora* TE clone 6 | 0.01 | 0.28 | 5.34 | 23.78 | 0.33 | 9.12 | 49.12 | 10.00 | 0.68 | 0.70 |
| SAD2BKO *C. camphora* TE clone 7 | 0.01 | 0.15 | 3.09 | 23.07 | 0.32 | 10.08 | 51.21 | 10.00 | 0.66 | 0.74 |

TABLE 35-continued

Lipid profile of thioesterase transformed clones.

| | C10:0 | C12:0 | C14:0 | C16:0 | C16:1 | C18:0 | C18:1 | C18:2 | C18:3 | C20 |
|---|---|---|---|---|---|---|---|---|---|---|
| SAD2BKO C. camphora TE clone 8 | 0.01 | 0.29 | 5.33 | 24.62 | 0.37 | 7.02 | 49.67 | 10.74 | 0.69 | 0.70 |
| SAD2BKO C. camphora TE clone 9 | 0.01 | 0.12 | 2.74 | 25.13 | 0.30 | 10.17 | 50.18 | 9.42 | 0.71 | 0.71 |
| wt UTEX 1435 | 0.01 | 0.02 | 0.96 | 23.06 | 0.79 | 3.14 | 61.82 | 9.06 | 0.46 | 0.27 |
| SAD2BKO | 0.01 | 0.03 | 0.80 | 23.66 | 0.13 | 19.56 | 43.12 | 9.83 | 1.00 | 1.18 |
| Tallow | 0.00 | 0.00 | 4.00 | 26.00 | 3.00 | 14.00 | 41.00 | 3.00 | 1.00 | 0.00 |

As can be seen in Table 35, the lipid profiles of the transgenic lines are quite similar to the lipid profile of tallow. Taken collectively, the data demonstrate the utility of combining specific transgenic backgrounds, in this case, a SAD2B knockout with a C14-preferring thioesterase (from *C. camphora*), to generate an transgenic algal strain that produce oil similar to the lipid profile of tallow.

B. RNAi Approach to Down-Regulation of Delta 12 Desaturase Gene (FADc) in *Prototheca* Cells Vectors down-regulating FADc (delta 12 desaturase gene) gene expression by RNAi were introduced into a *Prototheca moriformis* UTEX 1435 genetic background. The *Saccharomyces cerevisiae* suc2 sucrose invertase gene was utilized as a selectable marker, conferring the ability to grow on sucrose as a sole-carbon source to positive clones. The first type of constructs utilized a portion of the first exon of the FADc coding region linked in cis to its first intron followed by a repeat unit of the first exon in reverse orientation. This type of constructs theoretically leads to the formation of a hairpin RNA when expressed as mRNA. Two constructs of this first type were created, one driven by the *Prototheca moriformis* Amt03 promoter (SEQ ID NO: 89), termed pSZ1468, and a second construct driven by the *Chlamydomomas reinhardtii* β-tubulin promoter (SEQ ID NO: 114), termed pSZ 1469. A second type of constructs utilized the large FADc exon 2 in the antisense orientation driven by either the *Prototheca moriformis* Amt03 promoter (SEQ ID NO: 89), termed pSZ1470, or driven by the *Chlamydomomas reinhardtii* β-tubulin promoter (SEQ ID NO: 114), termed pSZ 1471. All four constructs had a *S. cerevisiae* suc2 sucrose invertase cassette (SEQ ID NO: 159) and a 5' (SEQ ID NO: 82) and 3' (SEQ ID NO: 84) homologous recombination targeting sequences (flanking the construct) to the 6S genomic region for integration into the nuclear genome. Sequences of the FADc portions of each RNAi construct along with the relevant portions of each construct are listed in the Sequence Listing as:

| Description | SEQ ID NO: |
|---|---|
| pSZ1468 FADc RNAi hairpin cassette | SEQ ID NO: 163 |
| Relevant portions of the pSZ1468 construct | SEQ ID NO: 164 |
| pSZ1469 FADc RNAi hairpin cassette | SEQ ID NO: 165 |
| Relevant portions of the pSZ1469 construct | SEQ ID NO: 166 |
| pSZ1470 FADc exon 2 RNAi cassette | SEQ ID NO: 167 |
| Relevant portions of the pSZ1470 construct | SEQ ID NO: 168 |
| pSZ1471 FADc exon 2 RNAi cassette | SEQ ID NO: 169 |
| Relevant portions of the pSZ1471 construct | SEQ ID NO: 170 |

Each of the four constructs were transformed into a *Prototheca moriformis* background and positive clones were screened using plates with sucrose as the sole carbon source. Positive clones were picked from each transformation and a subset were selected to determine the impact of the hairpin and antisense cassettes contained in pSZ1468, pSZ1469, pSZ1470 and pSZ1471 on fatty acid profiles. The selected clones from each transformation were grown under lipid producing conditions and the lipid profiles were determined using direct transesterification methods as described above. Representative lipid profiles from each of the transformations are summarized below in Table 36. Wildtype 1 and 2 cells were untransformed *Prototheca moriformis* cells that were run with each of the transformants as a negative control.

TABLE 36

Lipid profiles of *Prototheca moriformis* cells containing RNAi constructs to down-regulate the expression of delta 12 desaturase gene (FADc).

| Strain | C10:0 | C12:0 | C14:0 | C16:0 | C18:0 | C18:1 | C18:2 |
|---|---|---|---|---|---|---|---|
| wildtype 1 | 0.01 | 0.03 | 1.20 | 27.08 | 4.01 | 57.58 | 7.81 |
| pSZ1468 clone A | 0.01 | 0.04 | 1.33 | 25.95 | 3.68 | 65.60 | 1.25 |
| pSZ1468 clone B | 0.01 | 0.03 | 1.18 | 23.43 | 2.84 | 65.32 | 4.91 |
| pSZ1468 clone C | 0.01 | 0.04 | 1.34 | 23.18 | 4.27 | 63.65 | 5.17 |
| pSZ1468 clone D | 0.01 | 0.03 | 1.24 | 23.00 | 3.85 | 61.92 | 7.62 |
| pSZ1470 clone A | 0.01 | 0.03 | 1.23 | 24.79 | 4.33 | 58.43 | 8.92 |
| pSZ1470 clone B | 0.01 | 0.03 | 1.26 | 24.91 | 4.14 | 57.59 | 9.64 |
| pSZ1470 clone C | 0.01 | 0.03 | 1.21 | 23.35 | 4.75 | 58.52 | 9.70 |

TABLE 36-continued

Lipid profiles of *Prototheca moriformis* cells containing RNAi constructs to down-regulate the expression of delta 12 desaturase gene (FADc).

| Strain | C10:0 | C12:0 | C14:0 | C16:0 | C18:0 | C18:1 | C18:2 |
|---|---|---|---|---|---|---|---|
| wildtype 2 | 0.01 | 0.03 | 0.98 | 24.65 | 3.68 | 62.48 | 6.26 |
| pSZ1469 clone A | 0.01 | 0.03 | 1.05 | 21.74 | 2.71 | 71.33 | 1.22 |
| pSZ1469 clone B | 0.01 | 0.03 | 1.01 | 22.60 | 2.98 | 70.19 | 1.27 |
| pSZ1469 clone C | 0.01 | 0.03 | 1.03 | 19.82 | 2.38 | 72.95 | 1.82 |
| pSZ1469 clone D | 0.01 | 0.03 | 1.03 | 20.54 | 2.66 | 70.96 | 2.71 |
| pSZ1471 clone A | 0.01 | 0.03 | 1.03 | 18.42 | 2.63 | 66.94 | 8.55 |
| pSZ1471 clone B | 0.01 | 0.03 | 0.94 | 18.61 | 2.58 | 67.13 | 8.66 |
| pSZ1471 clone C | 0.01 | 0.03 | 1.00 | 18.31 | 2.46 | 67.41 | 8.71 |
| pSZ1471 clone D | 0.01 | 0.03 | 0.93 | 18.82 | 2.54 | 66.84 | 8.77 |

The above summarized results showed that the hairpin constructs, pSZ1468 and pSZ1469, showed specific expected phenotypes, namely a reduction in C18:2 fatty acid levels and an increase in C18:1 fatty acid levels as compared to wildtype 1 and wildtype 2, respectively. The antisense constructs, pSZ1470 and pSZ1471 did not result a decrease in C18:2 fatty acid levels, but instead showed a slight increase when compared to wildtype 1 and wildtype 2, respectively and a slight decrease in C16:0 fatty acid levels.

C. Expression of an Exogenous Stearoyl-ACP Desaturase

The *Olea europaea* stearoyl-ACP desaturase (GenBank Accession No. AAB67840.1) was introduced into a *Prototheca moriformis* UTEX1435 genetic background. The expression construct contained a 5' (SEQ ID NO: 82) and 3' (SEQ ID NO: 84) homologous recombination targeting sequences (flanking the construct) to the 6S genomic region for integration into the nuclear genome and a *S. cerevisiae* suc2 sucrose invertase coding region under the control of *C. reinhardtii* β-tubulin promoter/5'UTR and *Chlorella vulgaris* nitrate reductase 3' UTR. This *S. cerevisiae* suc2 expression cassette is listed as SEQ ID NO: 159 and served as a selection marker. The *Olea europaea* stearoyl-ACP desaturase coding region was under the control of the *Prototheca moriformis* Amt03 promoter/5'UTR (SEQ ID NO: 89) and *C. vulgaris* nitrate reductase 3'UTR, and the native transit peptide was replaced with the *Chlorella protothecoides* stearoyl-ACP desaturase transit peptide (SEQ ID NO: 49. The codon-optimized cDNA sequences and amino acid sequences (with the replaced transit peptide) are listed in the Sequence Listing as SEQ ID NO: 171 and SEQ ID NO: 172, respectively. The entire *O. europaea* SAD expression cassette was termed pSZ1377 and transformed into a *Prototheca moriformis* genetic background. Positive clones were screened on plates with sucrose as the sole carbon source. A subset of the positive clones were selected and grown under lipid production conditions and lipid profiles were determined using direct transesterification methods as described above. The lipid profiles of the selected clones are summarized in Table 37 below.

TABLE 37

Lipid profiles of *Olea europaea* stearoyl-ACP desaturase transgenic *Prototheca moriformis* cells.

| Strain | C14:0 | C16:0 | C18:0 | C18:1 | C18:2 |
|---|---|---|---|---|---|
| wildtype | 0.88 | 22.82 | 3.78 | 64.43 | 6.54 |
| pSZ1377 clone A | 0.94 | 18.60 | 1.50 | 69.45 | 7.67 |
| pSZ1377 clone B | 0.93 | 18.98 | 1.35 | 69.12 | 7.67 |
| pSZ1377 clone C | 0.93 | 19.01 | 2.31 | 68.56 | 7.43 |

The above summarized results demonstrate that the introduction of an heterologous desaturase, in this case a stearoyl-ACP desaturase from *Olea europaea*, can result in higher levels of C18:1 fatty acid and a concomitant decrease in C18:0 and C16:0 fatty acid levels.

Example 7

Engineering *Prototheca* to Produce Hydroxylated Fatty Acids

The *Ricinus communis* oleate 12-hydroxylase (Rc12hydro) (GenBank Accession No. AAC49010.1) was introduced into a *Prototheca moriformis* UTEX1435 genetic background. The expression construct contained a 5' (SEQ ID NO: 82) and 3' (SEQ ID NO: 84) homologous recombination targeting sequences (flanking the construct) to the 6S genomic region for integration into the nuclear genome and a *S. cerevisiae* suc2 sucrose invertase coding region under the control of *C. reinhardtii* β-tubulin promoter/5'UTR and *Chlorella vulgaris* nitrate reductase 3' UTR. This *S. cerevisiae* suc2 expression cassette is listed as SEQ ID NO: 159 and served as a selection marker. The *Ricinus communis* oleate 12-hydroxylase coding region was under the control of the *Prototheca moriformis* Amt03 promoter/5'UTR (SEQ ID NO: 89) and *C. vulgaris* nitrate reductase 3'UTR. The codon-optimized cDNA sequences and amino acid sequences are listed in the Sequence Listing as SEQ ID NO: 173 and SEQ ID NO: 174, respectively. The entire Rc12hydro expression cassette was termed pSZ1419 and transformed into a *Prototheca moriformis* genetic background. Positive clones were screened on plates with sucrose as the sole carbon source. A subset of the positive clones were selected and grown under lipid production conditions and screened for the product of the *R. communis* oleate 12-hydroxylase, namely, ricinoleic acid using a GC/MS method.

Figure 2:
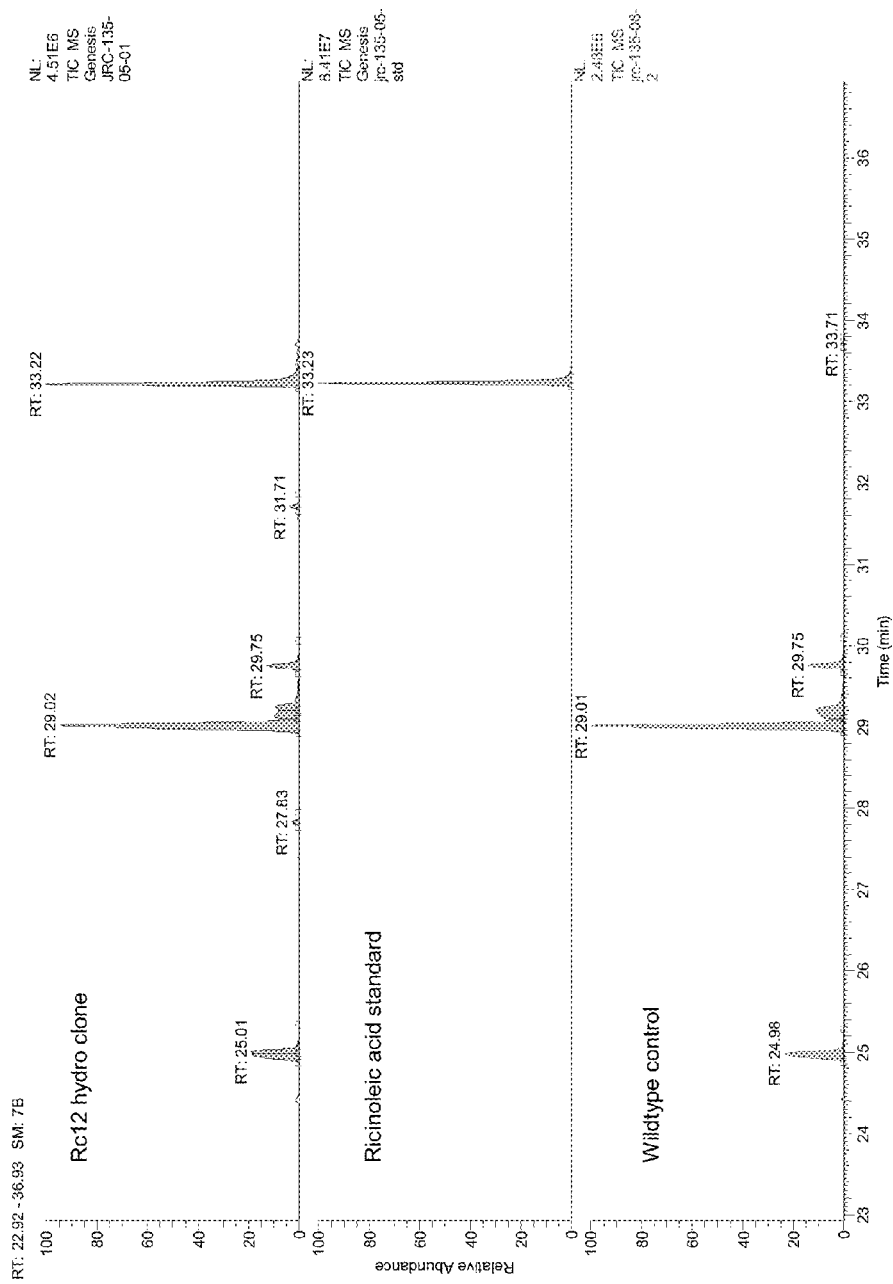
FIG. 2 shows GC retention times of a representative positive transgenic clone compared to the ricinoleic acid standard and a wildtype control.

The GC/MS method used to detect any ricinoleic acid produced in positive Rc12hydro transgenics was as follows. Samples of positive clones and a wildtype control were dried and then suspended in 2.2 mL of 4.5 $H_2SO_4$ in methanol-toluene, 10:1 (v/v). The mixture was then heated at 70-75° C. for 3.5 hours with intermittent sonication and vortexing. After cooling to room temperature, 2 mL of 6% $K_2CO_3$ (aq) and 2 mL of heptane was added, the mixture was then vortexed vigorously and the separation of layers was hastened by centrifugation at 900 rpm for 2 minutes. The upper layer was removed and concentrated to dryness with a stream of nitrogen. To the resulting oil was added 500 µL of dry pyridine and 500 µL of BSTFA/1% TMCS (Thermo Scientific). The resulting solution was heated at 70-75° C. for 1.5 hours and then concentrated to dryness with a stream of nitrogen. The residue was then resuspended in 2 mL of heptane and reconcentrated. Samples were resuspended in 2 mL of heptane and analyzed by GC/MS on a Thermo Trace GC Ultra/DSQII system in EI mode using selective ion monitoring of the base-peak of the TMS either of methyl ricinoleate (m/z 187). Fatty acid methyl esters were separated on a Restek Rxi-5Si1 MS column (0.25 mm ID, 30 m length, 0.5 µm film thickness) using helium as the carrier gas at a flow of 1 mL/min. The initial temperature of the column was held at 130° C. for 4 minutes, followed by a ramp of 4° C./min to a final temperature of 240° C. The presence of ricinoleic acid in samples was confirmed by comparison of retention time and full-scan mass spectra to an authentic sample of ricinoleic acid treated as described above. FIG. 2 shows the GC retention time of a representative positive transgenic clone compared to the ricinoleic acid standard and a wildtype control. The positive transgenic clone has a derivable peak at RT:33.22/33.23 which corresponds to a similar peak in the ricinoleic acid standard, indicating the presence of derivable ricinoleic acid in both the transgenic clone and the positive control. This peak was entirely lacking in the wildtype control sample.

Example 8

Engineering *Prototheca* with Alternative Selectable Markers

A. Expression of a Secretable α-Galactosidase in *Prototheca moriformis*

Methods and effects of expressing a heterologous sucrose invertase gene in *Prototheca* species have been previously described in PCT Application No. PCT/US2009/66142, hereby incorporated by reference. The expression of other heterologous polysaccharide degrading enzymes was examined in this Example. The ability to grow on melibiose (α-D-gal-glu) by *Prototheca moriformis* UTEX 1435 with one of the following exogenous gene encoding a α-galactosidase was tested: MEL1 gene from *Saccharomyces carlbergensis* (amino acid sequence corresponding to NCBI accession number P04824), AglC gene from *Aspergillus niger* (amino acid sequence corresponding to NCBI accession number Q9UUZ4), and the α-galactosidase from the higher plant *Cyamopsis tetragobobola* (Guar bean) (amino acid sequence corresponding to NCBI accession number P14749). The above accession numbers and corresponding amino acid sequences are hereby incorporated by reference. In all cases, genes were optimized according to the preferred codon usage in *Prototheca moriformis*. The relevant portions of the expression cassette are listed below along with the Sequence Listing numbers. All expression cassettes used the 5' and 3' Clp homologous recombination targeting sequences for stable genomic integration, the *Chlamydomonas reinhardtii* TUB2 promoter/5'UTR, and the *Chlorella vulgaris* nitrate reductase 3'UTR.

| | |
|---|---|
| *S. carlbergensis* MEL1 amino acid sequence | SEQ ID NO: 108 |
| *S. carlbergensis* MEL1 amino acid sequence signal peptide | SEQ ID NO: 109 |
| *S. carlbergensis* MEL1 transformation cassette | SEQ ID NO: 110 |
| *S. carlbergensis* MEL1 sequence (codon optimized) | SEQ ID NO: 111 |
| 5' Clp homologous recombination targeting sequence | SEQ ID NO: 112 |
| 3' Clp homologous recombination targeting sequence | SEQ ID NO: 113 |
| *Chlamydomonas reinhardtii* TUB2 promoter/5'UTR | SEQ ID NO: 114 |
| *Chlorella vulgaris* nitrate reductase 3'UTR | SEQ ID NO: 115 |
| *A. niger* AlgC amino acid sequence | SEQ ID NO: 116 |
| *A. niger* AlgC amino acid sequence signal peptide | SEQ ID NO: 117 |
| *A. niger* AlgC sequence (codon optimized) | SEQ ID NO: 118 |
| *A. niger* AlgC transformation cassette | SEQ ID NO: 119 |
| *C. tetragonobola* α-galactosidase amino acid sequence | SEQ ID NO: 120 |
| *C. tetragonobola* α-galactosidase sequence (codon optimized) | SEQ ID NO: 121 |
| *C. tetragonobola* α-galactosidase transformation cassette | SEQ ID NO: 122 |

*Prototheca moriformis* cells were transformed with each of the three expression cassettes containing *S. carlbergensis* MEL1, *A. niger* AlgC, or *C. tetragonobola* α-galactosidase gene using the biolistic transformation methods as described in Example 2 above. Positive clones were screened using plates containing 2% melibiose as the sole carbon source. No colonies appeared on the plates for the *C. tetragonobola* expression cassette transformants. Positive clones were picked from the plates containing the *S. carlbergensis* MEL1 transformants and the *A. niger* AlgC transformants. Integration of the transforming DNA was confirmed using PCR with primers targeting a portion of the *C. vulgaris* 3'UTR and the 3' Clp homologous recombination targeting sequence.

```
5' primer C.vulgaris 3'UTR:
downstream Clp sequence
                            (SEQ ID NO: 123)
ACTGCAATGCTGATGCACGGGA 3' primer C.vulgaris 3'UTR:
downstream Clp sequence
                            (SEQ ID NO: 124)
TCCAGGTCCTTTTCGCACT
```

As a negative control, genomic DNA from untransformed *Prototheca moriformis* cells were also amplified with the primer set. No products were amplified from genomic DNA from the wild type cells.

Several positive clones from each of the *S. carlbergensis* MEL1 transformants and the *A. niger* AlgC transformants (as confirmed by PCR) were tested for their ability to grow on melibiose as the sole carbon source in liquid media. These selected clones were grown for 3 days in conditions and base medium described in Example 1 above with melibiose as the sole carbon source. All clones containing either α-galactosidase-encoding genes grew robustly during this time, while the untransformed wild type strain and *Prototheca moriformis* expressing a *Saccharomyces cerevisiae* SUC2 sucrose invertase both grew poorly on the melibiose media. These results suggest that the α-galactosidase encoding genes may be used as a selectable marker for transformation. Also, these data indicate that the native signal peptides present in the *S. carlbergensis* MEL1 (SEQ ID NO: 109) or *A. niger* AlgC (SEQ ID NO: 117) are useful for targeting proteins to the periplasm in *Prototheca moriformis* cells.

B. THIC Genes Complements Thiamine Auxotrophy in *Prototheca*

Thiamine prototrophy in *Prototheca moriformis* cells was examined using expression of exogenous THIC genes. Thiamine biosynthesis in plants and algae is typically carried out in the plastid, hence most nuclear encoded proteins involved in its production will need to be efficiently targeted to the plastid. DNA sequencing and transcriptome sequencing of *Prototheca moriformis* cells revealed that all of the genes encoding the thiamine biosynthetic enzymes were present in the genome, with the exception of THIC. To dissect the lesion responsible for thiamine auxotrophy at the biochemical level, the growth of *Prototheca moriformis* cells under five different regimes were examined: (1) in the presence of 2 µM thiamine hydrochloride; (2) without thiamine; (3) without thiamine, but with 2 µM hydroxyethyl thiazole (THZ); (4) without thiamine, but with 2 µM 2-methyl-4-amino-5-(aminomethyl) pyrimidine (PYR); and (5) without thiamine, but with 2 µM THZ and 2 µM PYR. Results from the growth experiments under these 5 different conditions indicated that *Prototheca moriformis* cells are capable of de novo synthesis, but can only produce thiamine pyrophosphate (TPP) if the PYR precursor is provided. This result is consistent with the hypothesis that the thiamine auxotrophy of *Prototheca moriformis* is due to the inability to synthesize hydroxymethylpyrimidine phosphate (HMP-P) from aminoimidazole ribonucleotide, which is the conversion catalyze by THIC enzyme.

*Prototheca moriformis* cells were transformed using the biolistic transformation methods described above in Example 2, expressing the *Coccomyxa* C-169 THIC (amino acid sequence corresponding to JGI Protein ID 30481, and hereby incorporated by reference) and a *S. cerevisiae* SUC2 sucrose invertase as the selective marker. This expression construct contained the native transit peptide sequence from *Coccomyxa* C-169 THIC, upstream and downstream homologous recombination targeting sequences to the 6S region of genomic DNA, a *C. reinhardtii* TUB2 promoter/5'UTR region (SEQ ID NO: 104), and a *Chlorella vulgaris* nitrate reductase 3'UTR (SEQ ID NO: 115). The *S. cerevisiae* SUC2 expression was also driven by a *C. reinhardtii* TUB2 promoter/5'UTR region (SEQ ID NO: 114) and contained a *Chlorella vulgaris* nitrate reductase 3'UTR (SEQ ID NO: 115). Genes were optimized according to the preferred codon usage in *Prototheca moriformis*. The relevant expression cassette sequences are listed in the Sequence Listing and detailed below:

| | |
|---|---|
| *Coccomyxa* C-169 THIC amino acid sequence | SEQ ID NO: 125 |
| *Coccomyxa* C-169 THIC amino acid sequence native transit peptide | SEQ ID NO: 126 |
| *Coccomyxa* C-169 THIC transformation cassette | SEQ ID NO: 127 |
| *Coccomyxa* C-169 THIC sequence (codon optimized) | SEQ ID NO: 128 |
| *S. cerevisiae* SUC2 sequence (codon optimized) | SEQ ID NO: 129 |
| 5' 6S homologous recombination targeting sequence | SEQ ID NO: 82 |
| 3' 6S homologous recombination targeting sequence | SEQ ID NO: 84 |

Selection of positive clones were performed on plates without thiamine and containing sucrose as the sole carbon source. Positive clones were confirmed using PCR with a 5' primer that binds within the *Coccomyxa* C-169 THIC gene and a 3' primer that anneals downstream of the transforming DNA in the 6S locus. PCR confirmed positive clones were also confirmed using Southern blot assays.

To observe the thiamine auxotrophy of wildtype *Prototheca moriformis* cells, it was necessary to first deplete cells of internal thiamine reserves. To test growth in medium without thiamine, cells were first grown to stationary phase in medium containing 2 µM thiamine and then the cells were diluted to an optical density at 750 nm (OD750) of approximately 0.05 in medium without thiamine. The diluted cells were then grown once more to stationary phase in medium without thiamine (about 2-3 days). These thiamine-depleted cells were used to inoculate cultures for growth studies in medium without thiamine. Wildtype cells were grown in medium with glucose as the carbon source (with or without thiamine) and positive clones with the native transit peptide *Coccomyxa* C-169 THIC construct were grown in medium with sucrose as the sole carbon source. Growth was measured by monitoring the absorbance at 750 nm. Results of the growth experiments showed substantial greater growth in thiamine-free medium of strains expressing the transgene compared to wildtype cells in thiamine-free medium. However, the transformants failed to achieve the growth rate and cell densities of wildtype cells in thiamine-containing media. There was also a strong correlation between the amount of growth in the transformant clones in thiamine-free medium and the copy number of the integrated *Coccomyxa* enzyme (i.e., the more copy numbers of the transgene, the better the growth of the cells in thiamine-free medium).

Additional transformants were generated using expression constructs containing the *Coccomyxa* THIC, the *Arabidopsis thaliana* THIC gene, and the *Synechocystis* sp. PCC 6803 thiC gene. In the case of the *Coccomyxa* and the *A. thaliana* THIC gene, the native transit peptide sequence was replaced with the transit peptide sequence from a *Chlorella protothecoides* stearoyl-ACP desaturase (SAD) gene. *Synechocystis* sp. is a cyanobacterium and the thiC protein does not contain a native transit peptide sequence. In the *Synechocystis* sp thiC construct, the transit peptide sequence from a *Chlorella protothecoides* SAD gene was fused to the N-terminus of the *Synechocystis* sp. thiC. In all cases, the sequences were codon optimized for expression in *Prototheca moriformis*. All three of the foregoing constructs contained a upstream and downstream homologous recombination targeting sequence to the 6S region of the genome (SEQ ID NOs: 82 and 84), a *Chlorella protothecoides* actin promoter/5' UTR, and a *Chlorella protothecoides* EFTA gene 3'UTR. All three constructs contained a neoR gene driven by the *C. reinhardtii* TUB2 promoter/5'UTR (SEQ ID NO: 114) and contained the *C. vulgaris* 3'UTR (SEQ ID NO: 115), conferring the selection by G418. The amino acid sequence of the *A. thaliana* THIC corresponded to NCBI accession number NP_180524 and the amino acid sequence of the *Synechocystis* sp. thiC corresponded to NCBI accession number NP_442586, both sequences hereby incorporated by reference. The relevant expression cassette sequences are listed in the Sequence Listing and detailed below:

| | |
|---|---|
| *Coccomyxa* THIC expression construct with *C. protothecoides* transit peptide | SEQ ID NO: 130 |
| *Coccomyxa* THIC with *C. protothecoides* transit peptide | SEQ ID NO: 131 |
| *C. protothecoides* actin promoter/5' UTR | SEQ ID NO: 132 |
| *C. protothecoides* EF1A 3' UTR | SEQ ID NO: 133 |
| *A. thaliana* THIC expression construct | SEQ ID NO: 134 |
| *A. thaliana* THIC with *C. protothecoides* transit peptide | SEQ ID NO: 135 |
| *A. thaliana* THIC amino acid sequence with native transit peptide | SEQ ID NO: 136 |

| | |
|---|---|
| Synechocystis sp. thiC expression construct | SEQ ID NO: 137 |
| Synechocystis sp. thiC with C. prototheocides transit peptide | SEQ ID NO: 138 |
| Synechocystis sp. thiC amino acid sequence | SEQ ID NO: 139 |
| neoR gene | SEQ ID NO: 140 |

Positive clones were screened on plates containing G418 and several clones from each transformation were picked for verification by PCR. Integration of the transforming DNA constructs containing the *Coccomyxa* C-169 (with *C. protothecoides* transit peptide), *A. thaliana* and *Synechocystis* sp. PCC 6803 THIC genes, respectively into the 6S locus of the genome was confirmed using PCR analysis with the following primers:

```
5' THIC Coccomyxa confirmation primer sequence
                                    (SEQ ID NO: 141)
ACGTCGCGACCCATGCTTCC 3' THIC confirmation primer sequence
                                    (SEQ ID NO: 142)
GGGTGATCGCCTACAAGA 5' THIC A. thaliana confirmation primer sequence
                                    (SEQ ID NO: 143)
GCGTCATCGCCTACAAGA 5' thiC Synechocystis sp. confirmation primer
sequence
                                    (SEQ ID NO: 144)
CGATGCTGTGCTACGTGA
```

Growth experiments on thiamine depleted cells (as described above) were performed using selected confirmed positive clones from transformants of each of the different constructs in medium containing G418. All transformants were able to grow (with varying degrees of robustness) in thiamine-free medium. Comparison of the growth of the transformants in thiamine-free medium to wild type cells on thiamine-containing medium showed the following ranking with respect to their ability to support growth in thiamine-free medium: (1) *A. thaliana* transformants; (2) *Coccomyxa* C-169 (with *C. protothecoides* transit peptide) transformants; and (3) *Synechocystis* sp. transformants. These results suggest that while a single copy of *A. thaliana* THIC was able to complement thiamine auxotrophy in *Prototheca moriformis* cells, multiple copies of *Coccomyxa* C-169 (with either the native transit peptide sequence or a transit peptide sequence from *C. protothecoides*) and *Synechocystis* sp. THIC was required to enable rapid growth in the absence of thiamine. Given the variability in results of the different THIC from the different sources, the ability of any particular THIC gene to fully complement the lesion present in *Prototheca* species is not predictable.

An alignment of the three THIC amino acid sequences was performed. While there exist significant sequence conservation between thiC from *Synechocystis* sp. compared to the THICs from *Coccomyxa* and *A. thaliana* (41% identity at the amino acid level), the cyanobacterial protein is missing a domain at the N-terminus that is well-conserved in the algal and plant proteins. Despite the missing domain (and presumably resulting in structural differences), the construct expressing the *Synechocystis* sp. thiC was able to at least partially restore thiamine prototrophic in *Prototheca moriformis* cells.

Example 9

Fuel Production

A. Extraction of Oil from Microalgae Using an Expeller Press and a Press Aid

Microalgal biomass containing 38% oil by DCW was dried using a drum dryer resulting in resulting moisture content of 5-5.5%. The biomass was fed into a French L250 press. 30.4 kg (67 lbs.) of biomass was fed through the press and no oil was recovered. The same dried microbial biomass combined with varying percentage of switchgrass as a press aid was fed through the press. The combination of dried microbial biomass and 20% w/w switchgrass yielded the best overall percentage oil recovery. The pressed cakes were then subjected to hexane extraction and the final yield for the 20% switchgrass condition was 61.6% of the total available oil (calculated by weight). Biomass with above 50% oil dry cell weight did not require the use of a pressing aid such as switchgrass in order to liberate oil. Other methods of extraction of oil from microalgae using an expeller press are described in PCT Application No. PCT/US2010/31108 and is hereby incorporated by reference.

B. Production of Biodiesel from *Prototheca* Oil

Degummed oil from *Prototheca moriformis* UTEX 1435, produced according to the methods described above, was subjected to transesterification to produce fatty acid methyl esters. Results are shown in Table 38 below.

The lipid profile of the oil was:

| | |
|---|---|
| C10:0 | 0.02 |
| C12:0 | 0.06 |
| C14:0 | 1.81 |
| C14:1 | 0.07 |
| C16:0 | 24.53 |
| C16:1 | 1.22 |
| C18:0 | 2.34 |
| C18:1 | 59.21 |
| C18:2 | 8.91 |
| C18:3 | 0.28 |
| C20:0 | 0.23 |
| C20:1 | 0.10 |
| C20:1 | 0.08 |
| C21:0 | 0.02 |
| C22:0 | 0.06 |
| C24:0 | 0.10 |

TABLE 38

Biodiesel profile from *Prototheca moriformis* triglyceride oil.

| Method | Test | Result | Units |
|---|---|---|---|
| ASTM D6751 A1 | Cold Soak Filterability of Biodiesel Blend Fuels | Filtration Time | 120 | sec |
| | | Volume Filtered | 300 | ml |
| ASTM D93 | Pensky-Martens Closed Cup Flash Point | Procedure Used | A | |
| | | Corrected Flash Point | 165.0 | ° C. |

TABLE 38-continued

Biodiesel profile from *Prototheca moriformis* triglyceride oil.

| Method | Test | Result | Units |
|---|---|---|---|
| ASTM D2709 | Water and Sediment in Middle Distillate Fuels (Centrifuge Method) | Sediment and Water | 0.000 | Vol % |
| EN 14538 | Determination of Ca and Mg Content by ICP OES | Sum of (Ca and Mg) | <1 | mg/kg |
| EN 14538 | Determination of Ca and Mg Content by ICP OES | Sum of (Na and K) | <1 | mg/kg |
| ASTM D445 | Kinematic/Dynamic Viscosity | Kinematic Viscosity @ 104° F./40° C. | 4.873 | mm$^2$/s |
| ASTM D874 | Sulfated Ash from Lubricating Oils and Additives | Sulfated Ash | <0.005 | Wt % |
| ASTM D5453 | Determination of Total Sulfur in Light Hydrocarbons, Spark Ignition Engine Fuel, Diesel Engine Fuel, and Engine Oil by Ultraviolet Fluorescence. | Sulfur, mg/kg | 1.7 | mg/kg |
| ASTM D130 | Corrosion-Copper Strip | Biodiesel-Cu Corrosion 50° C. (122° F.)/3 hr | 1a | |
| ASTM D2500 | Cloud Point | Cloud Point | 6 | ° C. |
| ASTM D4530 | Micro Carbon Residue | Average Micro Method Carbon Residue | <0.10 | Wt % |
| ASTM D664 | Acid Number of Petroleum Products by Potentiometric Titration | Procedure Used Acid Number | A 0.20 | mg KOH/g |
| ASTM D6584 | Determination of Free and Total Glycerin in B-100 Biodiesel Methyl Esters By Gas Chromatography | Free Glycerin Total Glycerin | <0.005 0.123 | Wt % Wt % |
| ASTM D4951 | Additive Elements in Lubricating Oils by ICP-AES | Phosphorus | 0.000200 | Wt % |
| ASTM D1160 | Distillation of Petroleum Products at Reduced Pressure | IBP | 248 | ° C. |
| | | AET @ 5% Recovery | 336 | ° C. |
| | | AET @ 10% Recovery | 338 | ° C. |
| | | AET @ 20% Recovery | 339 | ° C. |
| | | AET @ 30% Recovery | 340 | ° C. |
| | | AET @ 40% Recovery | 342 | ° C. |
| | | AET @ 50% Recovery | 344 | ° C. |
| | | AET @ 60% Recovery | 345 | ° C. |
| | | AET @ 70% Recovery | 347 | ° C. |
| | | AET @ 80% Recovery | 349 | ° C. |
| | | AET @ 90% Recovery | 351 | ° C. |
| | | AET @ 95% Recovery | 353 | ° C. |
| | | FBP | 362 | ° C. |
| | | % Recovered | 98.5 | % |
| | | % Loss | 1.5 | % |
| | | % Residue | 0.0 | % |
| | | Cold Trap Volume | 0.0 | ml |
| | | IBP | 248 | ° C. |
| EN 14112 | Determination of Oxidation Stability (Accelerated Oxidation Test) | Oxidation Stability Operating Temp (usually 110 deg C.) | >12 110 | hr ° C. |
| ASTM D4052 | Density of Liquids by Digital Density Meter | API Gravity @ 60° F. | 29.5 | ° API |
| ASTM D 6890 | Determination of Ignition Delay (ID) and Derived Cetane Number (DCN) | Derived Cetane Number (DCN) | >61.0 | |

The lipid profile of the biodiesel was highly similar to the lipid profile of the feedstock oil. Other oils provided by the methods and compositions of the invention can be subjected to transesterification to yield biodiesel with lipid profiles including (a) at least 4% C8-C14; (b) at least 0.3% C8; (c) at least 2% C10; (d) at least 2% C12; and (3) at least 30% C8-C14.

The Cold Soak Filterability by the ASTM D6751 A1 method of the biodiesel produced was 120 seconds for a volume of 300 ml. This test involves filtration of 300 ml of B100, chilled to 40° F. for 16 hours, allowed to warm to room temp, and filtered under vacuum using 0.7 micron glass fiber filter with stainless steel support. Oils of the invention can be transesterified to generate biodiesel with a cold soak time of less than 120 seconds, less than 100 seconds, and less than 90 seconds.

C. Production of Renewable Diesel

Degummed oil from *Prototheca moriformis* UTEX 1435, produced according to the methods described above and having the same lipid profile as the oil used to make biodiesel in this Example, above, was subjected to transesterification to produce renewable diesel.

The oil was first hydrotreated to remove oxygen and the glycerol backbone, yielding n-paraffins. The n-parrafins were then subjected to cracking and isomerization. A chromatogram of the material is shown in FIG. 1. The material was then subjected to cold filtration, which removed about 5% of the C18 material. Following the cold filtration the total volume material was cut to flash point and evaluated for flash point, ASTM D-86 distillation distribution, cloud point and viscosity. Flash point was 63° C.; viscosity was 2.86 cSt (centistokes); cloud point was 4° C. ASTM D86 distillation values are shown in Table 39:

TABLE 39

ASTM D86 distillation values.
Readings in ° C.:

| Volume | Temperature |
|---|---|
| IBP | 173 |
| 5 | 217.4 |
| 10 | 242.1 |
| 15 | 255.8 |
| 20 | 265.6 |
| 30 | 277.3 |
| 40 | 283.5 |
| 50 | 286.6 |
| 60 | 289.4 |
| 70 | 290.9 |
| 80 | 294.3 |
| 90 | 300 |
| 95 | 307.7 |
| FBP | 331.5 |

The T10-T90 of the material produced was 57.9° C. Methods of hydrotreating, isomerization, and other covalent modification of oils disclosed herein, as well as methods of distillation and fractionation (such as cold filtration) disclosed herein, can be employed to generate renewable diesel compositions with other T10-T90 ranges, such as 20, 25, 30, 35, 40, 45, 50, 60 and 65° C. using triglyceride oils produced according to the methods disclosed herein.

The T10 of the material produced was 242.1° C. Methods of hydrotreating, isomerization, and other covalent modification of oils disclosed herein, as well as methods of distillation and fractionation (such as cold filtration) disclosed herein, can be employed to generate renewable diesel compositions with other T10 values, such as T10 between 180 and 295, between 190 and 270, between 210 and 250, between 225 and 245, and at least 290.

The T90 of the material produced was 300° C. Methods of hydrotreating, isomerization, and other covalent modification of oils disclosed herein, as well as methods of distillation and fractionation (such as cold filtration) disclosed herein can be employed to generate renewable diesel compositions with other T90 values, such as T90 between 280 and 380, between 290 and 360, between 300 and 350, between 310 and 340, and at least 290.

The FBP of the material produced was 300° C. Methods of hydrotreating, isomerization, and other covalent modification of oils disclosed herein, as well as methods of distillation and fractionation (such as cold filtration) disclosed herein, can be employed to generate renewable diesel compositions with other FBP values, such as FBP between 290 and 400, between 300 and 385, between 310 and 370, between 315 and 360, and at least 300.

Other oils provided by the methods and compositions of the invention can be subjected to combinations of hydrotreating, isomerization, and other covalent modification including oils with lipid profiles including (a) at least 4% C8-C14; (b) at least 0.3% C8; (c) at least 2% C10; (d) at least 2% C12; and (3) at least 30% C8-C14.

Although this invention has been described in connection with specific embodiments thereof, it will be understood that it is capable of further modifications. This application is intended to cover any variations, uses, or adaptations of the invention following, in general, the principles of the invention and including such departures from the present disclosure as come within known or customary practice within the art to which the invention pertains and as may be applied to the essential features hereinbefore set forth.

Example 10

Engineering Microorganisms to Produce C18:2 and C18:3 Glycerolipids

The synthesis of lipids in algae and plants starts with conversion of Glucose or other carbon sources into acetyl CoA via the plastidic pyruvate dehydrogenase complex. Next, Acetyl CoA carboxylase (ACCase) utilizing bicarbonate as a substrate, generates the 3-C compound, malonyl CoA. β-ketoacyl-ACP (acyl carrier protein) synthase III (KAS III) then catalyzes the first condensation reaction between malonyl CoA and Acetyl CoA to produce a 4-C compound. Successive 2-C additions through C16:0 are catalyzed by KAS I. The final 2-C extension to C18:0 is catalyzed by KAS II. Thioesterases (TEs) terminate elongation off of the acyl-ACP. The soluble enzyme, Stearoyl ACP desaturase (SAD) has activity toward C18:0-ACP substrates and forms the double bond at the 49 position resulting in oleate-ACP. The resulting C18:1 fatty acid is liberated from the ACP via the action of either an oleate or broad specificity TE.

All fatty acids, once liberated from ACP in the plastid are transported to the ER where lipid (TAG) biosynthesis occurs. Broadly speaking, there are two routes for lipid biosynthesis in the ER of higher plants, however the two pathways no doubt share substrates at some level. The fatty acyl CoA independent pathway transfers fatty acyl groups between phosphatidyl choline (P-choline) moieties employing acyllysophosphatidylcholine acyl transferases that may exhibit very selective substrate specificities, ultimately transferring them to diacylglycerol (DAG). The enzyme diacylglycerol acyltransferase (DGAT) carries out the final transfer of fatty acyl groups from an acyl CoA substrate to DAG resulting in the final triacyl glycerol. The fatty acyl CoA dependent pathway, on the other hand, transfers fatty acyl groups using fatty acyl CoAs as substrates onto glycerol-3-phosphate, lysophosphatidic acid (LPA) and DAG through the actions of glycerol phosphate acyltransferase (GPAT), lysophosphatidic acid acyltransferase (LPAAT) and DGAT, respectively.

Enzymes useful in engineering microorganisms to synthesize TAGs comprising C18:2 and C18:3 include β-ketoacyl- ACP synthase Hs (KAS II), stearoyl ACP desaturases (SADs), thioesterases, including oleate specific thioesterases, fatty acid desaturases (FADs), and glycerolipid desaturases, such as ω-6 fatty acid desaturases, ω-3 fatty acid desaturases, or ω-6-oleate desaturases. These different enzymes can be overexpressed in microorganisms either singly or in combination to increase C18:2 or C18:3 fatty acid or TAG production. Increasing the expression of KAS II enzyme activity pushes carbon accumulation from palmitate (C16:0) toward stearate (C18:0) and beyond. The amino acid sequences of several candidate KAS II enzymes are shown below in Table 40. The KAS II sequences disclosed are from higher plant species that specifically produce elevated levels of oleic, linoleic or linolenic fatty acids. A skilled artisan will be able to identify other genes for KAS II, including without limitation *Jatropha curcas* (GenBank Accession No. ABJ90469.2), *Glycine max* (GenBank Accession No. AAW88762.1), *Elaeis oleifera* (GenBank Accession No. ACQ41833.1), *Arabidopsis thaliana* (GenBank Accession No. AAL91174), *Vitis vinifera* (GenBank Accession No. CBI27767), and *Gossypium hirsutum* (GenBank Accession No. ADK23940.1).

TABLE 40

Exemplary KAS II enzymes.

| KAS II enzyme | SEQ ID NO |
|---|---|
| Ricinus communis | SEQ ID NO: 175 |
| Helianthus annus | SEQ ID NO: 176 |
| Brassica napus | SEQ ID NO: 177 |
| Glycine max | SEQ ID NO: 178 |
| P. moriformis | SEQ ID NO: 179 |

Converting increased levels of stearates to oleic acid (C18: 1) for the production of elevated levels of linoleic and linolenic fatty acids is achieved through microbial overexpression of one or more lipid pathway enzymes. Two additional enzymatic activities that have utility in elevating the levels of unsaturates are the stearoyl ACP desaturases (SAD) and oleate specific thioesterases. Converting increased levels of stearates (C18:0) to oleic acid through the action of one or both of these enzymes is first accomplished for the formation of linoleic and linolenic fatty acids.

The amino acid sequences of exemplary SAD enzymes useful for overexpression for elevating oleic acid levels are referenced in Table 41. In addition, the endogenous SAD from *P. moriformis* (SEQ ID NO:180) is also effective for increasing C18:1 levels. The SAD sequences disclosed are from higher plant species that specifically produce elevated levels of oleic, linoleic or linolenic fatty acids. A skilled artisan will be able to identify other genes for SADs.

TABLE 41

Exemplary SAD enzymes.

| SAD enzyme | SEQ ID NO | GenBank ID No. |
|---|---|---|
| Ricinus communis | SEQ ID NO: 196 | ACG59946.1 |
| Helianthus annus | SEQ ID NO: 197 | AAB65145.1 |
| Brassica juncea | SEQ ID NO: 198 | AAD40245.1 |
| Glycine max | SEQ ID NO: 199 | ACJ39209.1 |
| Olea europaea | SEQ ID NO: 200 | AAB67840.1 |
| Vernicia fordii | SEQ ID NO: 201 | ADC32803.1 |

SAD enzymes have activity toward C18:0-ACP substrates and form the carbon-carbon double bond at the 49 position resulting in oleate-ACP. The resulting C18:1 fatty acid is liberated from the ACP via the action of either an oleate or broad specificity TE. We have shown in the examples herein that the over expression of the *Olea europaea* stearoyl-ACP desaturase (Accession No: AAB67840.1; SEQ ID NO: 172) or the *Carthamus tinctorius* ACP thioesterase (Accession No: AAA33019.1; SEQ ID NO: 195) results in increased accumulation of C18:1 fatty acids. The amino acid sequences of exemplary oleate thioesterases useful for increasing oleic fatty acids are referenced in Table 42. A skilled artisan will be able to identify other genes for oleate thioesterases.

TABLE 42

Exemplary thioesterases for elevated oleic fatty acid production.

| Thioesterase Enzyme | SEQ ID NO | GenBank ID No. |
|---|---|---|
| Helianthus annus | SEQ ID NO: 202 | AAL79361.1 |
| Brassica rapa | SEQ ID NO: 203 | AAC49002.1 |
| Jatropha curcas | SEQ ID NO: 204 | ABX82799.3 |
| Zea mays | SEQ ID NO: 205 | ACG40089.1 |
| Zea mays | SEQ ID NO: 206 | ACG42559.1 |

Fatty acid desaturates are additional enzymes that have utility in increasing accumulation of linoleic and linolenic fatty acids in microbes. In particular, two enzymatic activities, FAD 2 and FAD 3, provide increased accumulation of linoleic and linolenic fatty acids in microbes. The amino acid sequences of exemplary FAD 2 and FAD 3 enzymes are shown below in Table 43.

TABLE 43

Exemplary FAD 2 and FAD 3 enzymes.

| FAD 2 and FAD 3 enzymes | SEQ ID NO |
|---|---|
| Linus usitatissimum 12 desaturase | SEQ ID NO: 181 |
| Linus usitatissimum 15 desaturase | SEQ ID NO: 182 |
| Linus usitatissimum 15 desaturase | SEQ ID NO: 183 |
| Carthamus tinctorus 12 desaturase | SEQ ID NO: 184 |
| Helianthus annus 12 desaturase | SEQ ID NO: 185 |

In addition to those enzymes listed in Table 43, the amino acid sequences of exemplary Δ12 FAD enzymes are listed in Table 44. Other Δ12 FAD enzymes suitable for overexpression in microorganisms are referenced in Table 45. The amino acid sequences of exemplary Δ15 FADs and other enzymes useful for increasing the level of unsaturated fatty acids and TAGs are listed in Table 46. Additional glycerolipid desaturase enzymes are provided in Table 47.

TABLE 44

Exemplary Δ12 FAD enzymes for increasing linoleic fatty acid production.

| Δ12 FAD enzyme | SEQ ID NO | GenBank ID No. |
|---|---|---|
| Carthamus tinctorius | SEQ ID NO: 207 | ADM48790.1 |
| Gossypium hirsutum | SEQ ID NO: 208 | CAA71199.1 |
| Glycine max | SEQ ID NO: 209 | BAD89862.1 |
| Zea mays | SEQ ID NO: 210 | ABF50053.1 |
| Prototheca moriformis allele 1 | SEQ ID NO: 211 | |
| Prototheca moriformis allele 2 | SEQ ID NO: 212 | |

TABLE 45

Additional Δ12 FAD enzymes suitable for overexpression in microorganisms to increase linoleic acid or linolenic acid.

| Δ12 FAD enzymes | GenBank Accession No. |
|---|---|
| Vernonia galamensis | AAF04094.1 |
| Vernonia galamensis | AAF04093.1 |

TABLE 45-continued

Additional Δ12 FAD enzymes suitable for overexpression in microorganisms to increase linoleic acid or linolenic acid.

| Δ12 FAD enzymes | GenBank Accession No. |
|---|---|
| Wrightia tinctoria | ADK47520.1 |
| Olea europaea | AAW63041.1 |
| Vernicia fordii | AAN87573 |
| Arabidopsis thaliana | AAA32782.1 |
| Camelina sativa | ADU18247.1 |
| Camelina sativa | ADU18248.1 |
| Camelina sativa | ADU18249.1 |
| Carthamus tinctorius | ADK94440.1 |
| Glycine max | BAD89862.1 |
| Glycine max | DQ532371.1 |
| Gossypium hirsutum | AAL37484.1 |
| Linum usitatissimum | ACF49507.1 |
| Linum usitatissimum | ACF49508.1 |
| Oenothera biennis | ACB47482 |
| Saccharomyces cerevisiae | NP_011460.1 |
| Zea mays | ACG37433.1 |
| Brassica rapa | CAD30827.1 |

TABLE 46

Exemplary Δ15 FAD enzymes for increasing linolenic fatty acid production

| Δ15 FAD enzyme | SEQ ID NO | GenBank ID No. |
|---|---|---|
| Brassica napa | SEQ ID NO: 213 | AAA32994.1 |
| Camelina sativa | SEQ ID NO: 214 | |
| Camelina sativa | SEQ ID NO: 215 | |
| Glycine max | SEQ ID NO: 216 | ACF19424.1 |
| Vernicia fordii | SEQ ID NO: 217 | AAF12821.1 |
| Ricinus communis | SEQ ID NO: 218 | EEF36775.1 |
| Linum usitatissimum | SEQ ID NO: 219 | ADV92272.1 |
| Prototheca moriformis allele 1 | SEQ ID NO: 220 | |
| Prototheca moriformis allele 2 | SEQ ID NO: 221 | |

TABLE 47

Glycerolipid desaturases suitable for overexpression in microorganisms to increase linolenic acid or increase levels of unsaturated TAGs.

| Glycerolipid desaturases | GenBank Acession No. |
|---|---|
| Glycine max | ACD69577.1 |
| Glycine max cultivar volania | ACS15381.1 |
| Glycine soja | P48621.1 |
| Arabidopsis thaliana | NP_180559.1 |
| Linum grandiflorum | BAG70949.1 |
| Zea mays | BAA22440.1 |
| Olea europaea | ABG88130.2 |
| Jatropha curcas | ABX82798.1 |
| Vernicia fordii | CAB45155.1 |
| Vernicia fordii | AAD13527.1 |

The amino acid sequences disclosed herein are expressed in microbes utilizing the methods disclosed herein. Coding sequences can be optimized for expression in the microorganism. For example, for expression in *P. moriformis*, preferred codon usage as disclosed in Table 2 herein are utilized.

Example 11

Engineering Microorganisms for Increased Production of Linolenic Unsaturated Fatty Acids and Glycerolipids As described in Example 10, Δ15 desaturase enzymes catalyze the formation of a double bond at position 15 of C18:2 (linoleic) fatty acids or fatty acyl molecules, thereby generating C18:3 (linolenic) fatty acids or fatty acyl molecules. Certain higher plant species, including *Brassica napus* (Bn), *Camelina sativa* (Cs), and *Linum usitatissimum*, which produce oils rich in linolenic unsaturated fatty acids, are sources of genes encoding Δ15 desaturases that can be expressed in microorganisms to affect fatty acid profiles. This example describes the use of polynucleotides that encode Δ15 desaturases enzymes to engineer microorganisms in which the fatty acid profile of the transformed microorganism has been enriched in linolenic acid.

A classically mutagenized (for higher oil production) derivative of *Prototheca moriformis* UTEX 1435, strain A, was transformed with individually with each of the plasmid constructs listed in Table 49 according to the biolistic transformation methods detailed in Example 2. Each construct contained a 5' (SEQ ID NO: 82) and 3' (SEQ ID NO: 84) homologous recombination targeting sequences (flanking the construct) to the 6S genomic region for integration into the nuclear genome and a *S. cerevisiae* suc2 sucrose invertase coding region under the control of *C. reinhardtii* β-tubulin promoter/5'UTR and *Chlorella vulgaris* nitrate reductase 3' UTR. This *S. cerevisiae* suc2 expression cassette is listed as SEQ ID NO: 159 and the sucrose invertase gene served as a selection marker. All protein-coding regions were codon optimized to reflect the codon bias inherent in *Prototheca moriformis* UTEX 1435 nuclear genes, in accordance with Table 2. The coding regions of desaturase genes from *Brassica napus* (Bn FAD3, GenBank Accession No. AAA32994), *Camelina sativa* FAD-7, and *Linum usitatissimum* (Lu FAD3A and Lu FAD3B, GenBank Accession Nos. ABA02172 and ABA02173) were each under the control of the *Prototheca moriformis* Amt03 promoter/5'UTR (SEQ ID NO: 89) and *C. vulgaris* nitrate reductase 3'UTR. A FLAG® epitope sequence was encoded in the N-terminus cytoplasmic loop of the recombinant desaturase gene sequences.

TABLE 49

Plasmid cibstructs used to transform *Protheca moriformis* (UTEX 1435) strain A.

| Plasmid Construct | Relevant Sequence Elements | SEQ ID NO: |
|---|---|---|
| pSZ2124 | 6S::Crβtub:ScSuc2:Cvnr::PmAmt03: 3xFlag-BnFad3:Cvnr::6S | SEQ ID NO: 222 |
| pSZ2125 | 6S::Crβtub:ScSuc2:Cvnr::PmAmt03: 3xFlag-CsFad7-1:Cvnr::6S | SEQ ID NO: 223 |
| pSZ2126 | 6S::Crβtub:ScSuc2:Cvnr::PmAmt03: 3xFlag-LuFad3A:Cvnr::6S | SEQ ID NO: 224 |
| pSZ2127 | 6S::Crβtub:ScSuc2:Cvnr::PmAmt03: 3xFlag-LuFad3B:Cvnr::6S | SEQ ID NO: 225 |

Each of the constructs pSZ2124, pSZ2125, pSZ2126, and pSZ2127 was transformed individually into strain A. Primary transformants were selected on agar plates containing sucrose as a sole carbon source. Individual transformants were clonally purified and grown at pH 7.0 under conditions suitable for lipid production, similar those disclosed in Example 1. Lipid samples were prepared from dried biomass from each transformant. 20-40 mg of dried biomass from each was resuspended in 2 mL of 5% $H_2SO_4$ in MeOH, and 200 ul of toluene containing an appropriate amount of a suitable internal standard (C19:0) was added. The mixture was sonicated briefly to disperse the biomass, then heated at 70-75° C. for 3.5 hours. 2 mL of heptane was added to extract the fatty acid methyl esters, followed by addition of 2 mL of 6% $K_2CO_3$ (aq) to neutralize the acid. The mixture was agitated vigorously, and a portion of the upper layer was transferred to a vial containing $Na_2SO_4$ (anhydrous) for gas chromatography analysis using standard FAME GC/FID (fatty acid methyl ester gas chromatography flame ionization detection) methods. Fatty acid profiles were analyzed using standard fatty acid methyl ester gas chromatography flame ionization (FAME GC/FID) detection methods. The resulting fatty acid profiles (expressed as Area % of total fatty acids) from a set of representative clones arising from strain A transformations of pSZ2124, pSZ2125, pSZ2126 and pSZ2127 are shown in Table 50. For comparison, fatty acid profiles of lipids obtained from untransformed strain A control cells are additionally presented in Table 50.

TABLE 50

Unsaturated C18:1, C18:2, and C18:3 fatty acid profiles of Prototheca moriformis cells engineered to express exogenous desaturase enzymes of higher plants.

| Strain | Sample | % of Total Fatty Acids | | |
|---|---|---|---|---|
| | | C18:1 | C18:2 | C18:3 |
| strain A | 1 | 55.68 | 7.99 | 0.63 |
| untransformed | 2 | 55.31 | 8.16 | 0.7 |
| pSZ2124 | Transformant 1 | 60.42 | 1.62 | 7.69 |
| Brassica napus | Transformant 2 | 59.7 | 0.6 | 8.49 |
| FAD3 | Transformant 3 | 60.56 | 1.19 | 8.15 |
| | Transformant 4 | 59.85 | 0.8 | 7.9 |
| pSZ2125 | Transformant 1 | 57.11 | 9.45 | 1.4 |
| Camelina | Transformant 2 | 57.5 | 8.56 | 1.39 |
| sativa FAD7 | Transformant 3 | 56.27 | 8.78 | 1.39 |
| | Transformant 4 | 52.57 | 9.39 | 1.7 |
| pSZ2126 | Transformant 1 | 58.97 | 0.84 | 9.67 |
| Linum | Transformant 2 | 57.93 | 1.36 | 11.92 |
| usitatissimum | Transformant 3 | 59.37 | 0.58 | 10.33 |
| FAD3A | Transformant 4 | 59.05 | 0.49 | 10.24 |
| pSZ2127 Linum | Transformant 1 | 59.6 | 1.67 | 8.67 |
| usitatissimum | Transformant 2 | 59.73 | 1.02 | 8.6 |
| FAD3B | Transformant 3 | 60.04 | 1.6 | 8.74 |
| | Transformant 4 | 58.57 | 0.89 | 9.05 |

The untransformed Prototheca moriformis (UTEX 1435) strain A strain exhibits a fatty acid profile comprising less than 1% C18:3 fatty acids. In contrast, fatty acid profiles of strain A expressing higher plant fatty acid desaturase enzymes showed increased composition of C18:3 fatty acids, ranging from about 2 to 17 fold increase. Engineered strains expressing FAD3A or FAD3B of Linum usitatissimum or the FAD5 gene product of Brassica napus showed the greatest degree of C18:3 increase (Table 50). The ratio of 18:3 to total C18 unsaturates was about 1% in the untransformed strains and ranged from about 2% to 17% in the transformed strains. The ratio of 18:2 to total C18:0 was about 12-13% in the untransformed strains and ranged from about 1% to 15% in the transformed strains with the lowest levels in the FAD3A transformant. These data demonstrate the utility and effectiveness of polynucleotides permitting exogenous expression of Δ15 desaturase fatty acid desaturase enzymes to alter the fatty acid profile of engineered microorganisms, and in particular in increasing the concentration of 18:3 fatty acids in microbial cells.

Example 12

Engineering Microorganisms for Increased Production of Stearic Acid and Stearate through a Hairpin RNA Approach Stearoyl ACP desaturase (SAD) enzymes are a part of the lipid synthesis pathway. They function to introduce double bonds into fatty acyl chains. For example, SAD enzymes catalyze the synthesis of C18:1 fatty acids from C18:0 fatty acids (stearic acid). As shown in Example 6, interruption of SAD2 alleles of Prototheca moriformis through targeted gene disruption resulted in measurable increases in C18:0 fatty acid levels in the fatty acid profiles of the engineered microorganism. This example describes the use of polynucleotides encoding hairpin RNAs that down-regulate the expression of SAD2 to engineer microorganisms in which the fatty acid profile of the transformed microorganism has been enriched in saturated C18:0 fatty acids.

Four constructs, pSZ2139-pSZ2142, listed in Table 51, were designed to attenuate expression of the Prototheca moriformis SAD2 gene product. Each construct contained a different nucleic acid sequence encoding a hairpin RNA targeted against the Prototheca moriformis SAD2 mRNA transcript, with a stem length ranging in size from 180 to 240 base pairs, as well as 5' (SEQ ID NO: 82) and 3' (SEQ ID NO: 84) homologous recombination targeting sequences (flanking the construct) to the 6S genomic region for integration into the nuclear genome and a S. cerevisiae suc2 sucrose invertase coding region under the control of C. reinhardtii β-tubulin promoter/5'UTR and Chlorella vulgaris nitrate reductase 3' UTR. This S. cerevisiae suc2 expression cassette is listed as SEQ ID NO: 159 and served as a selection marker. The polynucleotide sequence encoding the SAD2 RNA hairpin of each construct was under the control of the C. reinhardtii β-tubulin promoter/5'UTR and C. vulgaris nitrate reductase 3' UTR.

TABLE 51

Plasmid constructs used to transform Protheca moriformis (UTEX 1435) strain A.

| Plasmid Construct | Relevant Sequence Elements | SEQ ID NO: |
|---|---|---|
| SZ2139 hairpin A | 6S::Crβtub:ScSuc2:Cvnr:Crβtub: PmSAD2-hpA:Cvnr::6S | SEQ ID NO: 226 |
| SZ2140 hairpin B | 6S::Crβtub:ScSuc2:Cvnr:Crβtub: PmSAD2-hpB:Cvnr::6S | SEQ ID NO: 227 |
| SZ2141 hairpin C | 6S::Crβtub:ScSuc2:Cvnr:Crβtub: PmSAD2-hpC:Cvnr::6S | SEQ ID NO: 228 |
| SZ2142 hairpin D | 6S::Crβtub:ScSuc2:Cvnr:Crβtub: PmSAD2-hpD:Cvnr::6S | SEQ ID NO: 229 |

A classically mutagenized (for higher oil production) derivative of Protheca moriformis UTEX 1435, strain A, was transformed individually with the plasmid constructs listed in Table 51 according to biolistic transformation methods detailed in Example 2. Primary transformants were selected on agar plates containing sucrose as a sole carbon source, clonally purified, and grown under standard lipid production conditions. Fatty acid profiles were determined using direct transesterification methods as described in Example 11. The resulting fatty acid profiles (expressed as Area % of total fatty acids) from a set of representative clones arising from transformations of strain A with pSZ2139, pSZ2140, pSZ2141, and pSZ2142 are shown in Table 52, below. For comparison, fatty acid profiles of lipids obtained from untransformed strain A control cells are additionally presented in Table 52.

TABLE 52

C18:0, C18:1, and C18:2 fatty acid profiles of *Prototheca moriformis* cells engineered to express hairpin RNA constructs targeting stearoyl ACP desaturase gene/gene products.

| Strain/Plasmid Construct | Transformant | % Total Fatty Acids | | | % Ratio C18 Sat: C18 UnSat |
|---|---|---|---|---|---|
| | | C18:0 | C18:1 | C18:2 | |
| strain A | Untransformed | 2.77 | 60.74 | 7.27 | 4 |
| strain A/pSZ2139 hairpin A | Transformant 1 | 6.39 | 51.69 | 9.06 | 11 |
| | Transformant 2 | 5.49 | 52.89 | 9.25 | 9 |
| | Transformant 3 | 3.39 | 56.12 | 8.85 | 5 |
| | Transformant 4 | 3.24 | 54.55 | 8.62 | 5 |
| strain A/pSZ2140 hairpin B | Transformant 1 | 22.14 | 36.14 | 8.13 | 50 |
| | Transformant 2 | 17.19 | 41.17 | 8.31 | 35 |
| | Transformant 3 | 9.45 | 49.81 | 8.79 | 16 |
| | Transformant 4 | 5.61 | 53.8 | 9.02 | 9 |
| strain A/pSZ2141 hairpin C | Transformant 1 | 20.7 | 40.96 | 6.45 | 44 |
| | Transformant 2 | 16.33 | 45.57 | 7.31 | 31 |
| | Transformant 3 | 13.43 | 44.79 | 9.04 | 25 |
| | Transformant 4 | 12.7 | 46.25 | 9.98 | 23 |
| | Transformant 5 | 8.47 | 50.65 | 9.12 | 14 |
| strain A/pSZ2142 hairpin D | Transformant 1 | 26.99 | 30.93 | 8.31 | 69 |
| | Transformant 2 | 10.96 | 47.27 | 9.9 | 19 |
| | Transformant 3 | 8.64 | 50.77 | 11.7 | 14 |
| | Transformant 4 | 7.67 | 49.76 | 9.39 | 13 |

The data presented in Table 52 show a clear impact of the expression of SAD2 hairpin RNA constructs on the C18:0 and C18:1 fatty acid profile of the host organism. The fatty acid profiles of strain A transformants comprising SAD2 hairpin RNA constructs demonstrated an increase in the percentage of saturated C18:0 fatty acids with a concomitant diminution of unsaturated C18:1 fatty acids. Fatty acid profiles of the untransformed strain comprise about 3% C18:0. Fatty acid profiles of the transformed strains comprise greater than 3% to almost 27% C18:0. The ratio of C18:0 to total C18 unsaturates was about 4% in the untransformed strains and ranged from about 5% to 69% in the transformed strains. These data illustrate the successful expression and use of polynucleotide SAD RNA hairpin constructs in *Prototheca moriformis* to alter the percentage of saturated fatty acids in the engineered host microbes, and in particular in increasing the concentration of C18:0 fatty acids and decreasing C18:1 fatty acids in microbial cells.

Example 13

Altering Fatty Acid Profiles of Microalgae through Overexpression of β-Ketoacyl-ACP Synthase II Genes β-ketoacyl-ACP synthase II (KASII) catalyzes the 2-carbon extension of C16:0-ACP to C18:0-ACP during fatty acid biosynthesis. Plasmid constructs were created to assess whether the fatty acid profile of a host cell can be affected as a result of expression of a KASII gene. Sources of KASII gene sequences were selected from *Protheca moriformis* UTEX 1435 or from higher plants (*Glycine max* GenBank Accession No. AAW88763, *Helianthus annus* GenBank Accession No. ABI18155, and *Ricinus communis* GenBank Accession No. AAA33872).

A classically mutagenized (for higher oil production) derivative of *Protheca moriformis* UTEX 1435, strain A, was transformed individually with one of the following plasmid constructs in Table 53 using the methods of Example 2. Each construct comprised 5' (SEQ ID NO: 82) and 3' (SEQ ID NO: 84) homologous recombination targeting sequences (flanking the construct) to the 6S genomic region for integration into the nuclear genome and a *S. cerevisiae* suc2 sucrose invertase coding region under the control of *C. reinhardtii* β-tubulin promoter/5'UTR and *Chlorella vulgaris* nitrate reductase 3' UTR. This *S. cerevisiae* suc2 expression cassette is listed as SEQ ID NO: 29 and served as a selection marker. For each construct, the KASII coding region was under the control of the *Prototheca moriformis* Amt03 promoter/5'UTR (SEQ ID NO: 37) and *C. vulgaris* nitrate reductase 3'UTR. The native transit peptide of each KASII enzyme was replaced with the *Chlorella protothecoides* stearoyl-ACP desaturase transit peptide (SEQ ID NO: 54). All protein coding regions were codon optimized to reflect the codon bias inherent in *Prototheca moriformis* UTEX 1435 nuclear genes in accordance with Table 2.

TABLE 53

Plasmid constructs used to transform *Protheca moriformis* (UTEX 1435) strain A.

| Plasmid Construct | Source of KASII enzyme | Sequence Elements | SEQ ID. NO: |
|---|---|---|---|
| SZ1747 | *Glycine max* (Glm) | 6S::β-tub:suc2:nr::Amt03:S106SAD:GlmKASII:nr::6S | SEQ ID NO: 230 |
| SZ1750 | *Helianthus annuus* (Ha) | 6S::β-tub:suc2:nr::Amt03:S106SAD:HaKASII:nr::6S | SEQ ID NO: 231 |
| SZ1754 | *Ricinus communis* (Rc) | 6S::β-tub:suc2:nr::Amt03:S106SAD:RcKASII:nr::6S | SEQ ID NO: 232 |
| SZ2041 | *Protheca moriformis* (Pm) | 6S::β-tub:suc2:nr::Amt03:S106SAD:PmKASII:nr::6S | SEQ ID NO: 233 |

Relevant restriction sites in the construct 6S::β-Tub:suc2:nr::Amt03:S106SAD:PmKASII:nr::6S are indicated in lowercase, bold and underlining and are 5'-3' BspQ 1, Kpn I, Xba I, Mfe I, BamH I, EcoR I, Spe I, Asc I, Cla I, Sac I, BspQ I, respectively. BspQI sites delimit the 5' and 3' ends of the transforming DNA. Bold, lowercase sequences represent genomic DNA from strain A that permit targeted integration at the 6S locus via homologous recombination. Proceeding in the 5' to 3' direction, the *C. reinhardtii* β-tubulin promoter driving expression of the yeast sucrose invertase gene (conferring the ability of strain A to metabolize sucrose) is indicated by boxed text. The initiator ATG and terminator TGA for invertase are indicated by uppercase, bold italics while the coding region is indicated in lowercase italics. The *Chlorella vulgaris* nitrate reductase 3' UTR is indicated by lowercase underlined text followed by an endogenous amt03 promoter of *P. moriformis*, indicated by boxed italicized text. The Initiator ATG and terminator TGA codons of the PmKASII are indicated by uppercase, bold italics, while the remainder of the gene is indicated by bold italics. The *Chlorella protothecoides* S106 stearoyl-ACP desaturase transit peptide is located between the initiator ATG and the Asc I site. The *C. vulgaris* nitrate reductase 3' UTR is again indicated by lowercase underlined text followed by the strain A 6S genomic region indicated by bold, lowercase text. The relevant nucleotide sequence of the construct 6S::β-tub:suc2:nr::Amt03:S106SAD:PmKASII:nr::6S is provided in the sequence listings as SEQ ID. NO: 234. The codon-optimized sequence of PmKASII comprising a *Chlorella protothecoides* S106 stearoyl-ACP desaturase transit peptide is provided the sequence listings as SEQ ID. NO: 235. SEQ ID NO: 236 provides the protein translation of SEQ ID NO. 235.

gctcttcgccgccgccactcctgctcgagcgcgcccgcgcgtgcgccgccagcgccttggccttttcgccgcgctcgtgcgcgtcgctgatgt
ccatcaccaggtccatgaggtctgccttgccgccggctgagccactgcttcgtccgggcggccaagaggagcatgagggaggactcctggt
ccagggtcctgacgtggtcgcggctctgggagcgggccagcatcatctggctctgccgcaccgaggccgcctccaactggtcctccagca
gccgcagtcgccgccgaccctggcagaggaagacaggtgagggggtatgaattgtacagaacaaccacgagccttgtctaggcagaa
tccctaccagtcatggctttacctggatgacggcctgcgaacagctgtccagcgaccctcgctgccgccgcttctcccgcacgcttctttcca
gcaccgtgatggcgcgagccagcgccgcacgctggcgctgcgcttcgccgatctgaggacagtcggggaactctgatcagtctaaacccc
cttgcgcgttagtgttgccatcctttgcagaccggtgagagccgacttgttgtgcgccaccccacaccacctcctcccagaccaattctgt
cacctttttggcgaaggcatcggcctcggcctgcagagaggacagcagtgcccagccgctgggggttggcggatgcacgctcaggtacc c
tttcttgcgctatgacacttccagcaaaaggtagggcgggctgcgagacggcttcccggcgctgcatgcaacaccgatgatgcttcgacccccg
aagctcctccggggctgcatgggcgctccgatgccgctccaggggcgagcgctgtttaaatagccaggccccgattgcaaagacattatagcgag
ctaccaaagccatattcaaacacctagatcactaccacttctacacaggccactcgagcttgtgatcgcactccgctaagggggcgcctcttcctctt
cgtttcagtcacaacccgcaaac tctagaatatcaATGctgctgcaggccttcctgttcctgctggccggcttcgccgccaagatcagcgcctcc
atgacgaacgagacgtccgaccgcccctggtgcacttcacccccaacaagggctggatgaacgacccaacggcctgtggtacgacgag
aaggacgccaagtggcacctgtacttccagtacaacccgaacgacaccgtctggggacgcccttgttctggggccacgccacgtccgacg
acctgaccaactgggaggaccagcccatcgccatcgccccgaagcgcaacgactccggcgccttctccggctccatggtggtggactacaa
caacacctccggcttcttcaacgacaccatcgaccgcgccagcgctgcgtggccatctgacctacaacaccccggagtccgaggagcagt
acatctcctacagcctggacggcggctacaccttcaccgagtaccagaagaaccccgtgctggccgccaactccacccagttccgcgacccg
aagtcttctggtacgagccctcccagaagtggatcatgaccgcggccaagtcccaggactacaagatcgagatctactcctccgacgacctg
aagtcctggaagctggagtccgcgttcgccaacgagggcttcctcggctaccagtacgagtgccccggcctgatcgaggtccccaccgagca ggacccagcaagtcctactgggtgatgttcatctccatcaacccccggcgcccccggccggcggctccttcaaccagtacttcgtcggcagcttc
aacggcacccacttcgaggccttcgacaaccagtcccgcgtggtggacttcggcaaggactactacgccctgcagaccttcttcaacaccgac
ccgacctacgggagcgccctgggcatcgcgtgggcctccaactgggagtactccgccttcgtgcccaccaacccctggcgctcctccatgtcc
ctcgtgcgcaagttctccctcaacaccgagtaccaggccaacccggagacggagctgatcaacctgaaggccgagccgatcctgaacatca
gcaacgccgcccctggagccggttcgccaccaacaccacgttgacgaaggccaacagctacaacgtcgacctgtcaacagcaccggca
ccctggagttcgagctggtgtacgccgtcaacaccacccagacgatctccaagtccgtgttcgcggaccctctccctctggttcaagggcctgga
ggaccccgaggagtacctccgcatgggcttcgaggtgtccgcgtcctccttcttcctggaccgcgggaacagcaaggtgaagttcgtgaagga
gaaccccctacttcaccaaccgcatgagcgtgaacaaccagccctttcaagagcgagaacgacctgtcctactacaaggtgtacgcgcttgctgg
accagaacatcctggagctgtacttcaacgacgcgacgtcgtgtccaccaacacctacttcatgaccaccgggaacgccctgggctccgtg
aacatgacgacgggggtggacaacctgttctacatcgacaagttccaggtgcgcgaggtcaagTGAcaattggcagcagcagctcggata
gtatcgacacactctgaccgctggtcgtgtgatggactgttgccgccacacttgctgccttgacctgtgaatatccctgccgcttttatcaaacagcctc
agtgtgttttgatcttgtgtgtacgcgcttttgcgagttgctagctgcttgtgctatttgcgaataccaccccagcatcccttcctcgtttcatatcgctt
gcatcccaaccgcaacttatctacgctgtcctgctatccctcagcgctgctcctgctcctgctcactgcccctcgcacagccttggtttgggctccgcc
tgtattctcctggtactgcaacctgtaaaccagcactgcaatgctgatgcacgggaagtagtgggatgggaacacaaatggaggatccgcgtctc gaacagagcgcgcagaggaacgctgaaggtctcgcctctgtcgcacctcagcgcggcatacaccacaataaccacctgacgaatgcgcttggtt
cttcgtccattagcgaagcgtccggttcacacacgtgccacgttggcgaggtggcaggtgacaatgatcggtggagctgatggtcgaaacgttcac
agcctagggatatcgaattg gccgacaggacgcgcgtcaaaggtgctggtcgtgtatgccctggccgcaggtcgttgctgctgctggttagt
gattccgcaaccctcgattttggcgtcttattttggcgtggcaaacgctggcgcccgcgagccgggccggcggcgatgcggtgccccacggctg
ccggaatccaagggaggcaagagcgcccgggtcagttgaagggctttacgcgcaaggtacagccgctcctgcaaggctgcgtggtggaatt
ggacgtgcaggtcctgctgaagttcctccaccgcctcaccagcggacaaagcaccggtgtatcaggtccgtgtcatccactctaaagaactcg
actacgacctactgatgggccctagattcttcatcaaaaacgcctgagacacttgcccaggattgaaactccctgaagggaccaccaggggcc
ctgagttgttccttccccgtggcgagctgccagccaggctgtacctgtgatcgaggctggcgggaaaataggcttcgtgtgctcaggtcatgg
gaggtgcaggacagctcatgaaacgccaacaatcgcacaattcatgtcaagctaatcagctatttcctcttcacgagctgtaattgtcccaaaa
ttctggtctaccggggtgatccttcgtgtacgggccctccctcaaccctaggtatgcgcgcatgcgtcgccgcgcaactcgcgcgagggcc
gagggtttgggacgggccgtcccgaaatgcagttgcacccggatgcgtggcaccttttttgcgataatttatgcaatggactgctctgcaaaatt
ctggctctgtcgccaaccctaggatcagcggcgtaggatttcgtaatcattcgtcctgatggggagctaccgactaccctaatatcagcccgact
gcctgacgccagcgtccacttttgtgtcacacattccattcgtgcccaagacatttcattgtggtgcgaagcgtccccagttacgctcacctgtttcc
cgacctccttactgttctgtcgacagagcgggcccacaggccggtcgcagcca ctagtATGgccaccgcatccactttctcggcgttcaatg -continued

```
cccgctgcggcgacctgcgtcgctcggcgggctccgggcccgcgcccagcgaggccctccccgtgcgcgggcgcgccgccgccgccg
ccgacgccaacccgcccgccccgagcgccgcgtggtgatcaccggccagggcgtggtgacctccctgggccagaccatcgagcagttcta
ctcctccctgctggagggcgtgtccggcatctcccagatccagaagttcgacaccaccggctacaccaccaccatcgccggcgagatcaagt
ccctgcagctggacccctacgtgcccaagcgctgggccaagcgcgtggacgacgtgatcaagtacgtgtacatcgccggcaagcaggccct
ggagtccgccggcctgcccatcgaggccgccggcctggccggcgccggcctggacccccgccctgtgcggcgtgctgatcggcaccgccatg
gccggcatgacctccttcgccgccggcgtggaggccctgacccgcggcggcgtgcgcaagatgaacccctctgcatccccttctccatctcca
acatgggcggcgccatgctggccatggacatcggcttcatgggcccaactactccatctccaccgcctgcgccaccggcaactactgcatcc
tgggcgccgccgaccacatccgccggcggcgacgccaacgtgatgctggccggcggcgccgacgccgccatcatccccctccggcatcggcg
gcttcatcgcctgcaaggccctgtccaagcgcaacgacgagcccgagcgcgcctcccgccctgggacgccgaccgcgacggcttcgtgat
gggcgagggcgccggcgtgctggtgctggaggagctggagcacgccaagcgccgcggcgccaccatcctggccgagctggtgggcggcg
ccgccacctccgacgccaccacatgaccgagcccgaccccagggccgcggcgtgcgcctgtgcctggagcgcgccctggagcgcgccc
gcctggccccgagcgcgtgggctacgtgaacgcccacggcaccctccacccccgccggcgacgtggccgagtaccgcgccatccgcgccg
tgatcccccaggactccctgcgcatcaactccaccaagtccatgatcggccacctgctgggcggcgccggcgccgtggaggccgtggccgcc
atccaggccctgcgcaccggctggctgcaccccaacctgaacctggagaacccgcccccggcgtggaccccgtggtgctggtgggccccc
gcaaggagcgcgccgaggacctggacgtggtgctgtccaactccttcggcttcggcggccacaactcctgcgtgatcttccgcaagtacgacg
agatggactacaaggaccacgacggcgactacaaggaccacgacatcgactacaaggacgacgacgacaagTGAatcgatagatctct
```

Upon individual transformation of each plasmid construct into strain A, positive clones were selected on agar plates comprising sucrose as the sole carbon source. As in the previous examples, primary transformants were clonally purified and grown under standard lipid production conditions at pH 7 and lipid samples were prepared from dried biomass from each transformant. Fatty acid profiles were determined using direct transesterification methods as described in Example 11. The resulting fatty acid profiles (expressed as Area % of total fatty acids) from a set of representative clones arising from transformations of strain A Fatty acid profiles (expressed as Area %) of several positive transformants as compared to those of untransformed strain A controls are summarized for each plasmid construct in Table 54 below.

TABLE 54

Fatty acid profiles of *Prototheca moriformis* cells engineered to overexpress KAS II genes.

| Plasmid Construct | KASII Source | Trans-formant | % C14:0 | % C16:0 | % C18:0 | % C18:1 | % C18:2 |
|---|---|---|---|---|---|---|---|
| None | no over-expression | 1 | 1.36 | 28.69 | 2.92 | 56.36 | 8.16 |
| | | 2 | 1.35 | 28.13 | 3.57 | 55.63 | 8.79 |
| | | 3 | 1.22 | 25.74 | 2.82 | 60.6 | 7.31 |
| | | 4 | 1.22 | 25.74 | 2.82 | 60.6 | 7.31 |
| pSZ1747 | Glycine max | 1 | 2.23 | 25.34 | 2.69 | 57.35 | 9.53 |
| | | 2 | 2.18 | 25.46 | 2.74 | 57.35 | 9.46 |
| | | 3 | 2.18 | 25.33 | 2.89 | 57.34 | 9.5 |
| | | 4 | 2.2 | 25.69 | 2.66 | 57.28 | 9.43 |
| | | 5 | 2.17 | 25.38 | 3.03 | 56.99 | 9.72 |
| pSZ1750 | H. annus | 1 | 2.43 | 26.82 | 2.72 | 55.17 | 9.87 |
| | | 2 | 2.44 | 27.14 | 2.62 | 54.89 | 9.81 |
| | | 3 | 2.61 | 26.9 | 2.67 | 54.43 | 10.25 |
| | | 4 | 1.96 | 30.32 | 2.87 | 53.87 | 8.26 |
| | | 5 | 2.55 | 27.64 | 2.98 | 53.82 | 10.07 |
| pSZ1754 | Ricinus communis | 1 | 1.84 | 24.41 | 2.89 | 59.26 | 9.08 |
| | | 2 | 1.3 | 25.04 | 2.81 | 58.75 | 9.65 |
| | | 3 | 1.27 | 25.98 | 2.76 | 58.33 | 9.22 |
| | | 4 | 1.95 | 25.34 | 2.77 | 58.15 | 9.22 |
| | | 5 | 1.3 | 26.53 | 2.75 | 57.87 | 9.09 |
| pSZ2041 | P. moriformis | 1 | 1.63 | 11.93 | 3.62 | 70.95 | 9.64 |
| | | 2 | 1.85 | 11.63 | 3.34 | 69.88 | 10.93 |
| | | 3 | 1.84 | 12.01 | 3.81 | 69.56 | 10.45 |
| | | 4 | 1.63 | 14.22 | 3.72 | 68.86 | 9.6 |
| | | 5 | 1.67 | 15.04 | 3.05 | 68.63 | 9.24 |

A clear diminution of C16:0 chain lengths with a concomitant increase in C18:1 length fatty acids was observed upon overexpression of the *Prototheca moriformis* (UTEX 1435) KASII gene further codon optimized using the codon frequency denoted in Table 2 using pSZ2041. Similar fatty acid profile changes were observed upon transformation of constructs expressing the *Prototheca moriformis* (UTEX 1435) KASII gene driven by a β-tublin promoter.

These results show that exogenous overexpression of a codon optimized *Prototheca* lipid biosynthesis gene can alter the fatty acid profile of genetically engineered microalgae. In particular, overexpression of a KASII gene can increase the percentage of C18 fatty acids from about 68% in the untransformed cells to about 84%.

Example 14
Altering the Levels of Mid-Chain Fatty Acids in Engineered *Prototheca* through Targeted Knockout of a KASI Allele β-ketoacyl-ACP synthase I (KASI) catalyzes 2-carbon extensions of C4:0, C6:0, C8:0, C10:0, C12:0, and C14:0 fatty acyl-ACP molecules during fatty acid biosynthesis. In this example, a knockout plasmid construct, pSZ2014, was created to assess the impact on the fatty acid profile of a host cell upon targeted disruption of a KASI genetic locus.

A classically mutagenized (for higher oil production) derivative of *Protheca moriformis* UTEX 1435, strain A, was transformed the pSZ2014 construct using the biolistic transformations methods described in Example 2. pSZ2014 comprised the *S. cerevisiae* suc2 invertase expression cassette under control of the *C. reinhardtii* β-tubulin promoter and *Chlorella vulgaris* nitrate reductase 3' UTR, flanked on either side by KASI gene-specific homology regions to target the construct for integration into the KASI locus of the *Prototheca moriformis* genome. This *S. cerevisiae* suc2 expression cassette is listed as SEQ ID NO: 159 and served as a selection marker. Relevant sequences for the targeting regions to the KASI locus for nuclear genome integration are shown below and listed in SEQ ID NO: 238 and SEQ ID NO: 239. Relevant restriction sites in pSZ2014, indicated in lowercase, bold and underlining, are 5'-3' BspQ 1, Kpn I, AscI, Xho I, Sac I, BspQ I, respectively are shown in the sequence below. BspQI sites delimit the 5' and 3' ends of the transforming DNA. Bold, lowercase sequences represent genomic DNA from strain A that permit targeted integration at KASI locus via homologous recombination. Proceeding in the 5' to 3' direction, the *C. reinhardtii* b-tubulin promoter driving the expression of the codon-optimized yeast sucrose invertase gene (conferring the ability of strain A to metabolize sucrose) is indicated by boxed text. The initiator ATG codon and terminator TGA codon for suc2 invertase are indicated by uppercase, bold italics while the coding region is indicated in lowercase italics. The *Chlorella vulgaris* nitrate reductase 3' UTR is indicated by lowercase underlined text. The transforming sequence of pSZ2014 is shown below and listed as SEQ ID NO: 237.

```
gctcttcgctcaccgcgtgaattgctgtcccaaacgtaagcatcatcgtggctcggtcacgcgatcctggatccggggatcctagacgctggtggagagc
gctgccgtcggattggtggcaagtaagattgcgcaggttggcgaagggagagaccaaaaccggaggctggaagcgggcacaacatcgtattattgcgt
atagtagagcagtggcagtcgcatttcgaggtccgcaacggatctcgcaagctcgctacgctcacagtaggagaaaggggaccactgcccctgccaga
atggtcgcgaccctctccctcgccggccccgctgcaacacgcagtgcgtatccggcaagcgggctgtcgccttcaaccgccccatgttggcgtccggg
ctcgatcaggtgcgctgagggggggtttggtgtgcccgcgcctctgggccgtgtcggccgtgcggacgtggggccctgggcagtggatcagcagggtttg
cgtgcaaatgcctataccggcgattgaatagcgatgaacgggatacggttgcgctcactccatgccatgcgacccgtttctgtccgccagccgtggtcg
cccgggctgcgaagcgggacccccacccagcgcattgtgatcaccggaatgggcgtggggtacc cttcttgcgctatgacacttccagcaaaaggtagggc
gggctgcgagacggcttccggcgctgcatgcaacaccgatgatgcttcgaccccccgaagctccttcggggctgcatgggcgctccgatgccgctccag-
ggc
gagcgctgtttaaatagccaggcccccgattgcaaagacattatagcgagctaccaaagccatattcaaacacctagatcactaccacttctacacaggcc-
actcga
gcttgtgatcgcactccgctaagggggcgcctcttcctcttcgtttcagtcacaacccgcaaac ggcgcgccATG ctgctgcaggccttcctgttcctgct-
ggcc
ggcttcgccgccaagatcagcgcctccatgacgaacgagacgtccgaccgcccctggtgcacttcaccccaacaagggctggatgaacgacccaacg
gcctgtggtacgacgagaaggacgccaagtggcacctgtacttccagtacaacccgaacgacaccgtctgggggacgccttgttctggggccacgcc-
acg
tccgacgacctgaccaactgggaggaccagcccatcgccatcgccccgaagcgcaacgactccggcgccttctccggctccatggtggtggactacaaca
acacctccggcttcttcaacgacaccatcgaccgcgccagcgctgcgtggccatctggacctacaacaccccggagtccgaggagcagtacatctcct-
aca
gcctggacggcggctacaccttcaccgagtaccagaagaacccgtgctggccgccaactccacccagttccgcgacccgaaggtcttctggtacgagc-
cc
tcccagaagtggatcatgaccgcggccaagtccaggactacaagatcgagatctactcctccgacgacctgaagtcctggaagctggagtccgcgttc-
gc
caacgagggcttcctcggctaccagtacgagtgcccccggcctgatcgaggtccccaccgagcaggacccagcaagtcctactgggtgatgttcatctc-
cat
caaccccggcgccccggccggcggctccttcaaccagtacttcgtcggcagcttcaacggcacccacttcgaggccttcgacaaccagtcccgcgtggt-
gga
cttcggcaaggactactacgccctgcagaccttcttcaacaccgacccgacctacgggagcgccctgggcatcgcgtgggcctccaactgggagtactc-
cgc
cttcgtgcccaccaaccctggcgctcctccatgtccctcgtgcgcaagttctccctcaacaccgagtaccaggccaacccggagacggagctgatcaac-
ctg
```

-continued

```
aaggccgagccgatcctgaacatcagcaacgccggccctggagccggttcgccaccaacaccacgttgacgaaggccaacagctacaacgtcgacctg
tccaacagcaccggcaccctggagttcgagctggtgtacgccgtcaacaccacccagacgatctccaagtccgtgttcgcgcggacctctccctctggttc-
aagg
gcctggaggaccccgaggagtacctccgcatgggcttcgaggtgtccgcgtcctccttcttcctggaccgcgggaacagcaaggtgaagttcgtgaaggag
aaccoctacttcaccaacogcatgagcgtgaacaaccagcccttcaagagcgagaacgacctgtcctactacaaggtgtacggcttgctggaccagaacat
cctggagctgtacttcaacgacggcgacgtcgtgtccaccaacacctacttcatgaccaccgggaacgccctgggctccgtgaacatgacgacggggtgg
acaacctgttctacatcgacaagttccaggtgcgcgaggtcaagTGAcaattggcagcagcagctcggatagtatcgacacactctggacgctggtcgtgtg
atggactgttgccgccacacttgctgccttgacctgtgaatatccctgccgcttttatcaaacagcctcagtgtgtttgatcttgtgtgtacgcgctttt-
gcgagttgctag
ctgcttgtgctatttgcgaataccaccccccagcatcccccttccctcgtttcatatcgcttgcatcccaaccgcaacttatctacgctgtcctgctatccct-
cagcgctgctc
ctgctcctgctcactgccccctcgcacagccttggtttgggctccgcctgtattctcctggtactgcaacctgtaaaccagcactgcaatgctgatgcacgg-
gaagtag
tgggatgggaacacaaatggaggatcgtagagctccacctgcatccgcctggcgctcgaggacgccggcgtctcgcccgacgaggtcaactacgtcaacg
cgcacgccacctccaccctggtgggcgacaaggccgaggtgcgcgcggtcaagtcggtctttggcgacatgaagggcatcaagatgaacgccaccaag
tccatgatcgggcactgcctgggcgccgccggcggcatggaggccgtcgccacgctcatggccatccgcaccggctgggtgcacccaccatcaaccac
gacaacccatcgccgaggtcgacggcctggacgtcgtcgccaacgccaaggcccagcacaaaatcaacgtcgccatctccaactccttcggcttcggc
gggcacaactccgtcgtcgcctttgcgccttccgcgagtaggcggagcgagcgcgcttggctgaggagggaggcggggtgcgagcccttggctgcgc
gcgatactctccccgcacgagcagactccacgcgcctgaatctacttgtcaacgagcaaccgtgtgttttgtccgtggccattcttattatttctccgactgtg
gccgtactctgtttggctgtgcaagcaccgaagagc
```

Upon transformation of plasmid construct pSZ2014 into strain A, positive clones were selected on plates with sucrose as the sole carbon source. Primary transformants were clonally purified and grown under standard lipid production conditions. Lipid samples were prepared from dried biomass from each transformant. Fatty acid profiles were determined using direct transesterification methods as described in Example 11. Fatty acid profiles (expressed as Area % of total fatty acid) of several positive transformants, compared to those of untransformed strain A controls, are summarized for in Table 55 below.

TABLE 55

Fatty acid profiles of engineered *Prototheca moriformis* cells comprising a selectable marker to disrupt an endogenous KASI allele.

| | Transformant | % C14:0 | % C16:0 | % C18:0 | % C18:1 | % C18:2 |
|---|---|---|---|---|---|---|
| strain A | untransformed control | 1.22 | 25.61 | 2.82 | 60.76 | 7.44 |
| strain A pSZ2014 | Transformant 1 | 1.65 | 32.55 | 2.17 | 53.99 | 7.43 |
| | Transformant 2 | 2.25 | 30.04 | 2.57 | 55.86 | 7.12 |
| | Transformant 3 | 3.51 | 31.22 | 1.90 | 53.85 | 7.00 |
| | Transformant 4 | 4.09 | 31.51 | 2.57 | 53.14 | 6.21 |
| | Transformant 5 | 4.68 | 34.47 | 1.94 | 49.75 | 6.49 |
| | Transformant 6 | 5.68 | 37.98 | 1.83 | 44.76 | 6.75 |
| | Transformant 7 | 5.82 | 37.82 | 1.93 | 44.84 | 6.44 |

As shown in Table 55 above, targeted interruption of a KASI allele impacted the fatty acid profiles of transformed microorganisms. Fatty acid profiles of strain A comprising the pSZ2014 transformation vector showed increased composition of C14:0 and C16:0 fatty acids with a concomitant decrease in C18:1 fatty acids. In all transformants, C18:0 fatty acids were reduced. In some transformations, interruption of the KASI allele further resulted in a fatty acid profile comprising decreased percentages of C18:2 fatty acids relative to the fatty acid profile of the untransformed strain A organism.

Thus, we increased the percentage of total C14 fatty acids by about 35% to 400% and the percentage of C16 fatty acids by about 30 to 50% by disruption of an endogenous KASI.

These data demonstrate the utility of targeted gene interruption of an endogenous KASI allele to alter the fatty acid profile of a host microbe.

Example 15

Combining Genetic Modification Approaches to Alter Fatty Acid Profiles in *Prototheca*

In this example, the combination of genetic modifications to knockout a KASII allele and concomitantly overexpress an exogenous thioesterase exhibiting a preference for hydrolysis of mid chain fatty acids is demonstrated in a microorganism to alter the fatty acid profile of the host organism.

A classically mutagenized (for higher oil production) strain of *Prototheca moriformis* (UTEX 1435), strain C, was initially transformed with the plasmid construct pSZ1283 according to biolistic transformation methods detailed in Example 2. pSZ1283 (SEQ ID NO: 256), previously described in PCT Application Nos. PCT/US2011/038463 and PCT/US2011/038463, comprises the coding sequence of the *Cuphea wrightii* FATB2 (CwTE2) thioesterase, 5' (SEQ ID NO: 82) and 3' (SEQ ID NO: 84) homologous recombination targeting sequences (flanking the construct) to the 6S genomic region for integration into the nuclear genome, and a *S. cerevisiae* suc2 sucrose invertase coding region under the control of *C. reinhardtii* β-tubulin promoter/5'UTR and *Chlorella vulgaris* nitrate reductase 3' UTR. This *S. cerevisiae* suc2 expression cassette is listed as SEQ ID NO: 159 and served as a selection marker. The CwTE2 coding sequence was under the control of the *Prototheca moriformis* Amt03 promoter/5'UTR (SEQ ID NO: 89) and *C. vulgaris* nitrate reductase 3'UTR (SEQ ID NO: 32). The protein coding regions of CwTE2 and suc2 were codon optimized to reflect the codon bias inherent in *Prototheca moriformis* UTEX 1435 nuclear genes in accordance with Table 2.

Upon transformation of pSZ1283 into strain C, positive clones were selected on agar plates with sucrose as the sole carbon source. Primary transformants were then clonally purified and a single transformant, strain B, was selected for further genetic modification. This genetically engineered strain was transformed with a plasmid construct, pSZ2110 case, bold, and underlined formats. BspQI sites delimit the 5' and 3' ends of the transforming DNA. Bold, lowercase sequences at the 5' and 3' ends of the transforming construct represent genomic DNA from UTEX 1435 that target integration to the KASII allele 1 locus via homologous recombination. The *C. reinhardtii*-tubulin is indicated by lowercase, boxed text. The initiator ATG and terminator TGA for NeoR are indicated by uppercase italics, while the coding region is indicated with lowercase italics.

The 3' UTR is indicated by lowercase underlined text.

```
gctcttcgctggcctgttgccggacgatccgtgtcgtcgagactgcattttgttttgggtgtggggctggggtactggatggcttg
agggcatgacttttctgatggagaagattgcaatgagatcatttgggtcgtctatttgtttgctgtgcaagagggtttactggtat
ctggcaccagcttttggcccgtgcccgtttgatggacgcgtgacaggcaggcgtcctggaaagcacagacaccgtacgtacga
ccttgacctccccccttctccacacggcaggtgcgaggctgcccacggcgtcgaggcgggcggtgcgccgggcatggtcccg
catcgcgcgcgcggcggccgcggccgacgcaaacccgcccgccctgagcgccgcgtggtcatcacgggccagggcgtggt
gaccagcctgggccagacgatcgagcagttttacagcagcctgctggagggcgtgagcggcatctcgcagatacagaagttc
gacaccacgggctacacgacgacgatcgcgggcgagatcaagtcgctgcagctggaccgtacgtgcccaagcgctgggcg
aagcgcgtggacgacgtgataaagtacgtctacatcgcgggcaagcaggcgctggagagcgccggcctgccgatcgaggcg
gcggggctggcgggcgcggggctggaccggcgctgtgcggcgtgctcatcggcaccgccatggcgggcatgacgtctttcg
cggcgggcgtggaggcgctgacgcgcggtacc|ctttcttgcgctatgacacttccagcaaaaggtagggcgggctgcgagacgg
cttcccggcgctgcatgcaacaccgatgatgcttcgaccccccgaagctccttcggggctgcatgggcgctccgatgccgctccagg
gcgagcgctgtttaaatagccaggcccccgattgcaaagacattatagcgagctaccaaagccatattcaaacacctagatcactacc
acttctacacaggccactcgagcttgtgatcgcactccgctaaggggcgcctcttcctcttcgtttcagtcacaacccgcaaac|tctag
aatatcaATGatcgagcaggacggcctccacgccggctccccgcgcctgggtggagcgcctgttcggctacgactgggccc
agcagaccatcggctgctccgacgccgcgtgttccgcctgtccgcccagggccgccccgtgctgttcgtgaagaccgacctgtc
cggcgccctgaacgagctgcaggacgaggccgcccgcctgtcctggctggccaccaccggcgtgccctgcgccgccgtgctgg
acgtggtgaccgaggccggccgcgactggctgctgctgggcgaggtgcccggccaggacctgctgtcctcccacctggccccg ccgagaaggtgtccatcatggccgacgccatgcgccgcctgcacaccctggaccccgccacctgcccctttcgaccaccaggcca
agcaccgcatcgagcgcgcccgcacccgcatggaggccggcctggtggaccaggacgacctggacgaggagcaccagggc
ctggcccccgccgagctgttcgcccgcctgaaggcccgcatgcccgacggcgaggacctggtggtgacccacggcgacgcctg
cctgcccaacatcatggtggagaacggccgcttctccggcttcatcgactgcggccgcctgggcgtggccgaccgctaccaggac
atcgcctgccacccgcgacatcgccgaggagctgggcggcgagtgggccgaccgcttcctggtgctgtacggcatcgccgcc
cccgactcccagcgcatcgccttctaccgcctgctggacgagttcttcTGAcaattggcagcagcagctcggatatgtatcgacacs
ctctggacgctggtcgtgtgatggactgttgccgccacacttgctgccttgacctgtgaatatccctgccgcttttatcaaacagcctcagt
gtgtttgatcttgtgtgtacgcgcttttgcgagttgctagctgcttgtgctatttgcgaataccaccccagcatcccctcctcgttcatat
cgcttgcatcccaaccgcaacttatctacgctgtcctgctatccctcagcgctgctcctgctcctgctcactgcccctcgcacagccttgg
tttgggctccgcctgtattctcctggtactgcaacctgtaaaccagcactgcaatgctgatgcacgggaagtagtgggatgggaacaca
aatggaggatccactagttctagagcggccgccaccgcggtggagctcggcggcgtgcgcaagatgaaccccttttgcatcccct
tctccatctccaacatgggcggcgcgatgctggcgatggacatcggcttcatgggccccaactactccatctccacggcctgcg
cgacgggcaactactgcatcctgggcgcggcggaccacatccggcgcggcgacgcaaacgtgatgctggccggcggcgcgg
acgcggccatcatccctcgggcatcggcggcttcatcgcgtgcaaggcgctgagcaagcgcaacgacgagcccgagcgcg
cgagccggccctgggacgccgaccgcgacggcttcgtcatgggcgagggcgccggcgtgctggtgctggaggagctggagc
acgccaagcgccgcggcgcgaccattttggctgaattagttggcggcgcggccacctcggacgcgcaccacatgaccgagcc
cgacccgcagggccgcggcgtgcgcctctgcctcgagcgcgcgctcgagcgcgcgcgcctcgcgcccgagcgcgtcggctac
gtcaacgcgcacggcaccagcacgcccgcgggcgacgtggccgagtaccgcgccatccgcgcgtcatcccgcaggactca
ctacgcatcaactccacaaagtccatgatcgggcacctgctcggcggcgccggcgcggtcgaggccgtggccgccatccagg
ccctgcgaccggctggctccaccccaacttgaacctcgagaacccgcgcctggcgtcgacccgtcgtgctcgtgggctctt
cc
```

(SEQ ID NO: 240), to interrupt the KASII allele 1 locus. pSZ2110, written as KASII'5::CrbTub:NeoR:nr::KASII-'3, comprised a neomycin resistance (NeoR) expression cassette, conferring resistance to G418, under control of the *C. reinhardtii*-tubulin promoter and *Chlorella vulgaris* nitrate reductase 3' UTR, flanked on either side by KASII gene-specific homology regions to target the construct for integration into the KASII locus of the *Prototheca moriformis* genome. The relevant restriction sites in the pSZ2110 construct from 5'-3' are BspQ 1, KpnI, XbaI, MfeI, BamHI, EcoRI, SpeI, XhoI, Sac I, and BspQI are indicated in lower- Upon transformation of strain B with pSZ2110, positive clones were selected on selective agar plates containing G418. Primary transformants were then clonally purified and grown on sucrose as a carbon source under standard lipid production conditions at both pH 5.0 and at pH 7.0. Lipid samples were prepared from dried biomass from each transformant as described in Example 11. Fatty acid profiles (expressed as Area % of total fatty acids) of 5 positive transformants (T1-T5), profiles of strain B grown on sucrose as a sole carbon source (U1), and profiles of untransformed UTEX 1435 (U1) grown on glucose as a sole carbon source, are presented in Table 56 below.

TABLE 56

Fatty acid profiles of *Prototheca moriformis* (UTEX 1435) multiply engineered to ablate an endogenous KASII gene product and to express a *Cuphea wrightii* thioesterase.

| Fatty acid | pH | UTEX 1435 U1 | strain B U1 | strain B pSZ2011 | | | | |
|---|---|---|---|---|---|---|---|---|
| | | | | T1 | T2 | T3 | T4 | T5 |
| % C10:0 | pH 5.0 | 0.01 | * | 0.02 | 0.03 | 0.03 | 0.03 | 0.07 |
| | pH 7.0 | 0.01 | 5.35 | 4.94 | 4.79 | 4.70 | 4.10 | 4.12 |
| % C12:0 | pH 5.0 | 0.04 | * | 0.09 | 0.39 | 0.41 | 0.41 | 0.86 |
| | pH 7.0 | 0.04 | 27.06 | 25.31 | 25.03 | 25.02 | 23.54 | 23.47 |
| % C14:0 | pH 5.0 | 1.30 | * | 0.92 | 1.13 | 1.14 | 1.15 | 1.50 |
| | pH 7.0 | 1.56 | 15.20 | 14.49 | 14.22 | 14.50 | 15.84 | 15.85 |
| % C16:0 | pH 5.0 | 25.89 | * | 36.07 | 35.05 | 35.35 | 35.23 | 35.05 |
| | pH 7.0 | 29.80 | 13.89 | 14.96 | 14.88 | 15.11 | 22.62 | 22.94 |
| % C18:0 | pH 5.0 | 2.84 | * | 1.76 | 1.79 | 1.84 | 1.82 | 1.80 |
| | pH 7.0 | 3.00 | 1.44 | 1.57 | 1.71 | 1.49 | 1.37 | 1.33 |
| % C18:1 | pH 5.0 | 60.34 | * | 49.82 | 50.21 | 49.97 | 50.01 | 49.13 |
| | pH 7.0 | 54.96 | 28.57 | 29.84 | 30.45 | 30.27 | 24.18 | 23.96 |
| % C18:2 | pH 5.0 | 7.40 | * | 8.39 | 8.59 | 8.47 | 8.52 | 8.75 |
| | pH 7.0 | 8.15 | 6.85 | 7.19 | 7.16 | 7.15 | 6.51 | 6.65 |

* Not tested

As shown in Table 56, the impact of expression of CwTE2 in *Protheca moriformis* (UTEX 1435) strain B is a marked change in the fatty acid profiles of the transformed microorganisms. Fatty acid profiles of strain B strains expressing CwTE2 and cultured at pH 7.0, to promote expression of CwTE2 from the Amt03 promoter, showed increased composition of C10:0, C12:0, and C14:0 fatty acids with a concomitant decrease in the composition of C16:0 and C18:1 fatty acids relative to the fatty acid profile of untransformed UTEX 1435. Subsequent modification of strain B to interrupt a KASII allele, encoding an enzyme that catalyzes the 2-carbon extension of C16:0 to C18:0 fatty acids, resulted in an increase in C16:0 fatty acids with a concomitant decrease in C18:1 fatty acids present in the lipid profile of the newly engineered strain when grown at pH 5.0. Propagation of transformants at pH 5.0 illustrates the impact of the KASII allele knockout apart from the thioesterase contribution to the altered fatty acid profiles, as the pH of this culture medium is not optimal for activity of the Amt03 promoter. Upon lipid production at pH 7.0, thereby expressing CwTE2, pSZ2011 transformants exhibited a fatty acid profile increased in composition of C10:0, C12:0, and C14:0 fatty acids with a concomitant decrease in the composition of C16:0 and C18:1 fatty acids relative to the profile of the UTEX 1435 strain. Some pSZ2011 transformants when cultured at pH 7.0 exhibited a fatty acid profile enriched in C16:0 fatty acids with still a further decrease in the composition of C18:1 fatty acids relative to the fatty acid profile of their parent strain strain B cultured at pH 7.0.

These data demonstrate the utility of multiple genetic modifications to impact the fatty acid profile of a host organism. Further, this example illustrates the use of recombinant polynucleotides to target gene interruption of an endogenous KASII allele to alter the fatty acid profile of a host microbe.

Example 16

Combining Genetic Modification Approaches to Alter the Palmitic Acid Composition of *Protheca*

In this example, the combination of genetic modifications to knockout a KASII allele and concomitantly overexpress an exogenous thioesterase exhibiting preferential specificity for hydrolysis of C14 and C16 fatty acids is demonstrated in a microorganism to alter the fatty acid profile of the host organism.

A classically mutagenized (for higher oil production) strain of *Protheca moriformis* (UTEX 1435), strain A, was transformed with the plasmid construct pSZ2004 according to the biolistic transformation methods detailed in Example 2. pSZ2004, written as KASII_5'_btub-SUC2-nr_2X_Amt03-Ch16TE2-nr_KASII_3', comprised the coding sequence of the *Cuphea hookeriana* fatty acyl-ACP thioesterase (Ch16TE2, GenBank #Q39513), 5' and 3' homologous recombination targeting sequences (flanking the construct) for targeted integration at the KASII locus of the nuclear genome, and a *S. cerevisiae* suc2 sucrose invertase coding region under the control of *C. reinhardtii* β-tubulin promoter/ 5'UTR and *Chlorella vulgaris* nitrate reductase 3' UTR. Ch16TE2 is a thioesterase that show preferential specificity for C14 and C16 fatty acids. This *S. cerevisiae* suc2 expression cassette is listed as SEQ ID NO: 159 and served as a selection marker. The Ch16TE coding sequence was under the control of the *Protheca moriformis* Amt03 promoter/ 5'UTR (SEQ ID NO: 89) repeated in tandem, and *C. vulgaris* nitrate reductase 3'UTR. The protein coding regions of Ch16TE and suc2 were codon optimized to reflect the codon bias inherent in *Protheca moriformis* UTEX 1435 nuclear genes in accordance with Table 2. pSZ2004 is presented in the sequence listing as SEQ ID NO: 249.

Upon transformation with pSZ2004, primary transformants were selected on plates containing sucrose as a sole carbon source. Individual transformants were clonally purified and grown under standard lipid production conditions at pH 7.0, similar to the conditions as disclosed in Example 1. Fatty acid profiles were analyzed using standard fatty acid methyl ester gas chromatography flame ionization (FAME GC/FID) detection methods as described in Example 11. The resulting fatty acid profile (expressed as Area % of total fatty acid) from a representative clone arising from the transformations of the transformation vector pSZ2004 is shown in Table 57. The fatty acid profile of lipids obtained from the untransformed strain grown under lipid production conditions comprising glucose as a sole carbon source are additionally presented in Table 57.

TABLE 57

Fatty acid profiles of *Protheca moriformis* (UTEX 1435) multiply engineered to ablate an endogenous KASII gene product and to express a *Cuphea hookeriana* thioesterase.

| Fatty Acid | UTEX 1435 | pSZ2004 |
|---|---|---|
| % C10:0 | 0.01 | 0.00 |
| % C12:0 | 0.04 | 0.09 |
| % C14:0 | 1.27 | 6.42 |
| % C16:0 | 27.20 | 69.97 |
| % C18:0 | 3.85 | 1.84 |
| % C18:1 | 58.70 | 13.69 |
| % C18:2 | 7.18 | 7.15 |

As shown in Table 57 above, targeted interruption of a KASII allele with an expression cassette for expression of a selectable marker and a C14/C16 preferring thioesterase impacted the fatty acid profile of transformed microorganism. The fatty acid profile of the strain comprising the pSZ2004 transformation vector showed increased composition of C14:0 and C16:0 fatty acids with a concomitant decrease in C18:0 and C18:1 fatty acids. The untransformed *Protheca moriformis* (UTEX 1435) strain exhibited a fatty acid profile comprising about 27% C16 fatty acids and about 58% C18:1 fatty acids. In contrast, fatty acid profiles of the strain disrupted at the KASII locus by a cassette enabling expression of a *Cuphea hookeriana* fatty acyl-ACP thioesterase and a selectable marker comprised about 70% C16 fatty acids and about 14% fatty acids. The level of C16:0 was increased by over 2.5 fold. These data show that the genetic modifications of exogenous gene overexpression and endogenous gene ablation can be combined to alter fatty acid profiles in host organisms.

For comparison, fatty acid profiles of a strain disrupted at the KASII locus, by a cassette enabling expression of a sucrose invertase gene provided a strain with about 35% C16 fatty acids and about 50% C18:1 fatty acids.

These data demonstrate the utility and effectiveness of polynucleotides permitting exogenous expression of a thioesterase enzyme to alter the fatty acid profile of engineered microorganisms, in particular in increasing the concentration of C14 and C16 fatty acids and concomitantly, through targeted disruption of a KASII allele with said polynucleotides, effecting the decrease of C18:0 and C18:1 fatty acids in microbial cells.

Example 17

Engineering Microorganisms to Produce Linoleic Unsaturated Fatty Acids and Glycerolipids Certain Δ12 fatty acid desaturase enzymes can catalyze the formation of a double bond in C18:1 fatty acids or fatty acyl molecules, thereby generating C18:2 (linoleic) fatty acids or fatty acyl molecules. Certain plant species, including *Gossypium hirsutum, Carthamus ticntorius, Glycine max, Helianthus annus*, and *Zea mays*, which produce oils rich in linoleic unsaturated fatty acids, are sources of genes encoding Δ12 desaturases that can be expressed in microorganisms to affect fatty acid profiles. This example describes the use of polynucleotides that encode Δ12 desaturases enzymes to engineer microorganisms in which the fatty acid profile of the transformed microorganism has been enriched in linoleic acid.

A classically mutagenized (for higher oil production) derivative of *Protheca moriformis* UTEX 1435, strain A, was transformed with one of the following plasmid constructs listed in Table 58 according to biolistic transformation methods detailed in Example 2. Each construct contained 5' (SEQ ID NO: 82) and 3' (SEQ ID NO: 84) homologous recombination targeting sequences (flanking the construct) to the 6S genomic region for integration into the nuclear genome and a *S. cerevisiae* suc2 sucrose invertase coding region under the control of *C. reinhardtii* β-tubulin promoter/5'UTR and *Chlorella vulgaris* nitrate reductase 3' UTR. This *S. cerevisiae* suc2 expression cassette is listed as SEQ ID NO: 159 and served as a selection marker. All protein coding regions were codon optimized to reflect the codon bias inherent in *Protheca moriformis* UTEX 1435, in accordance with Table 2. The coding regions of desaturase genes from *Gossypium hirsutum* (Gh, GenBank Accession No. CAA71199), *Carthamus ticntorius* (Ct GenBank Accession No. ADM48789), *Glycine max* (Gm, GenBank Accession No. BAD89862), *Helianthus annus* (Ha, GenBank Accession No. AAL68983), and *Zea mays* (Zm, GenBank Accession No. ABF50053) were each under the control of the *Prototheca moriformis* Amt03 promoter/5'UTR (SEQ ID NO: 89) and *C. vulgaris* nitrate reductase 3'UTR.

TABLE 58

Plasmid constructs used to transform *Protheca moriformis* (UTEX 1435) strain A.

| Plasmid Construct | Relevant Sequence Elements | SEQ ID NO: |
|---|---|---|
| pSZ2150 | 6S::Crβtub:ScSuc2:Cvnr:: PmAmt03:CtFad2-2:Cvnr::6S | SEQ ID NO: 241 |
| pSZ2151 | 6S::Crβtub:ScSuc2:Cvnr:: PmAmt03:GlmFad2-2:Cvnr::6S | SEQ ID NO: 242 |
| pSZ2152 | 6S::Crβtub:ScSuc2:Cvnr:: PmAmt03:HaFad2:Cvnr::6S | SEQ ID NO: 243 |
| pSZ2153 | 6S::Crβtub:ScSuc2:Cvnr:: PmAmt03:ZmFad2:Cvnr::6S | SEQ ID NO: 244 |
| pSZ2172 | 6S::Crβtub:ScSuc2:Cvnr:: PmAmt03:GhFad2:Cvnr::6S | SEQ ID NO: 245 |

Each of the constructs listed in Table 58 was transformed individually into strain A. Primary transformants were selected on plates containing sucrose as a sole carbon source. Individual transformants were clonally purified and grown under standard lipid production conditions at pH 7.0, similar to the conditions as disclosed in Example 1. Fatty acid profiles were analyzed using standard fatty acid methyl ester gas chromatography flame ionization (FAME GC/FID) detection methods described in Example 11. The resulting fatty acid profiles from a set of representative clones arising from the corresponding strain A transformations of Table 58 are shown in Table 59. For comparison, fatty acid profiles of lipids obtained from untransformed strain A control cells are additionally presented in Table 59.

TABLE 59

C18:1, C18:2, and C18:3 fatty acid profiles of *Prototheca moriformis* cells engineered to express exogenous FAD desaturase enzymes.

| Strain | Sample | % of Total Fatty Acids | | | Total C18 unsaturates (% of Total Fatty Acids) | % C18 polyunsaturates/ total C18 unsaturates |
|---|---|---|---|---|---|---|
| | | C18:1 | C18:2 | C18:3 | | |
| strain A | Unstransformed | 55.37 | 8.18 | 0.7 | 64.25 | 13.82 |
| strain A | Transformant 1 | 58.29 | 11.96 | 0.75 | 71 | 17.90 |
| pSZ2150 Ct FAD2-2 | Transformant 2 | 59.00 | 10.29 | 0.84 | 70.13 | 15.87 |
| | Transformant 3 | 52.41 | 10.36 | 1.16 | 63.93 | 18.02 |
| | Transformant 4 | 56.77 | 10.17 | 0.8 | 67.74 | 16.19 |
| | Transformant 5 | 57.19 | 10.15 | 0.79 | 68.13 | 16.06 |
| strain A | Transformant 1 | 58.09 | 10.32 | 0.86 | 69.27 | 16.14 |
| pSZ2151 | Transformant 2 | 59.6 | 11.87 | 0.86 | 72.33 | 17.60 |
| Glm FAD2-2 | Transformant 3 | 58.93 | 11.54 | 0.83 | 71.3 | 17.35 |
| | Transformant 4 | 58.4 | 12.29 | 0.9 | 71.59 | 18.42 |
| | Transformant 5 | 58.27 | 10.8 | 0.83 | 69.9 | 16.64 |
| | Transformant 6 | 58.85 | 10.48 | 0.82 | 70.15 | 16.11 |

TABLE 59-continued

C18:1, C18:2, and C18:3 fatty acid profiles of *Prototheca moriformis* cells engineered to express exogenous FAD desaturase enzymes.

| Strain | Sample | % of Total Fatty Acids | | | Total C18 unsaturates (% of Total Fatty Acids) | % C18 polyunsaturates/ total C18 unsaturates |
|---|---|---|---|---|---|---|
| | | C18:1 | C18:2 | C18:3 | | |
| strain A | Transformant 1 | 59.30 | 10.02 | 0.82 | 70.14 | 15.45 |
| pSZ2152 Ha | Transformant 2 | 58.45 | 9.87 | 0.81 | 69.13 | 15.45 |
| FAD2 | Transformant 3 | 59.38 | 9.89 | 0.79 | 70.06 | 15.24 |
| | Transformant 4 | 59.54 | 9.79 | 0.81 | 70.14 | 15.11 |
| | Transformant 5 | 59.07 | 9.92 | 0.82 | 69.81 | 15.38 |
| | Transformant 6 | 59.57 | 10.02 | 0.55 | 70.14 | 15.07 |
| strain A | Transformant 1 | 64.30 | 11.18 | 0.89 | 76.37 | 15.80 |
| pSZ2153 Zm | Transformant 2 | 58.54 | 10.49 | 0.88 | 69.91 | 16.26 |
| FAD2 | Transformant 3 | 58.80 | 9.95 | 0.81 | 69.56 | 15.47 |
| | Transformant 4 | 56.18 | 10.81 | 1.16 | 68.15 | 17.56 |
| | Transformant 5 | 58.82 | 10.02 | 0.83 | 69.67 | 15.57 |
| | Transformant 6 | 58.72 | 10.06 | 0.86 | 69.64 | 15.68 |
| strain A | Transformant 1 | 55.71 | 10.85 | 0.84 | 67.4 | 17.34 |
| pSZ2172 | Transformant 2 | 56.12 | 10.29 | 0.75 | 67.16 | 16.44 |
| Gh-FLAG- | Transformant 3 | 54.14 | 12 | 0.96 | 67.1 | 19.31 |
| FAD2 | Transformant 4 | 55.72 | 11.68 | 0.75 | 68.15 | 18.24 |

The untransformed *Prototheca moriformis* (UTEX 1435) strain exhibits a fatty acid profile comprising less than 8.5% C18:2 fatty acids. As shown in Table 59. the lipid profiles of strain A strains expressing higher plant fatty acid desaturase enzymes showed increased C18:2 fatty acids. Total C18 unsaturated fatty acids increased from about 64% to about 67-72%. Similarly, the ratio of total C18 polyunsaturated fatty acids (C18:2 and C18:3) to total combined C18 unsaturated fatty acids (C18:1, C18:2 and C18:3) increased from less than 14% to over 19%. These data demonstrate the utility and effectiveness of polynucleotides permitting exogenous expression of Δ12 desaturase fatty acid desaturase enzymes to alter the fatty acid profile of engineered microorganisms.

Example 18

Altering the Levels of Fatty Acids of Engineered Microbes Through Multiple Allelic Disruption of a Fatty Acid Desaturase This example describes the use of a transformation vector to disrupt the FADc loci of *Prototheca moriformis* with a transformation cassette comprising a selectable marker and sequence encoding an exogenous SAD enzyme to engineer microorganisms in which the fatty acid profile of the transformed microorganism has been altered.

A classically mutagenized (for higher oil production) derivative of *Protheca moriformis* (UTEX 1435), strain C, was transformed with the transformation construct pSZ1499 (SEQ ID NO: 246) according to biolistic transformation methods detailed in Example 2. pSZ1499 comprised nucleotide sequence of the *Olea europaea* stearoyl-ACP desaturase gene, codon-optimized for expression in *Protheca moriformis* UTEX 1435. The pSZ1499 expression construct contained 5' (SEQ ID NO: 247) and 3' (SEQ ID NO: 248) homologous recombination targeting sequences (flanking the construct) to the FADc genomic region for integration into the nuclear genome and a *S. cerevisiae* suc2 sucrose invertase coding region under the control of *C. reinhardtii* β-tubulin promoter/5'UTR and *Chlorella vulgaris* nitrate reductase 3' UTR. This *S. cerevisiae* suc2 expression cassette is listed as SEQ ID NO: 159 and served as a selection marker. The *Olea europaea* stearoyl-ACP desaturase coding region was under the control of the *Prototheca moriformis* Amt03 promoter/5'UTR (SEQ ID NO: 89) and *C. vulgaris* nitrate reductase 3'UTR, and the native transit peptide was replaced with the *Chlorella protothecoides* stearoyl-ACP desaturase transit peptide (SEQ ID NO: 49). The entire *O. europaea* SAD expression cassette was termed pSZ1499 and can be written as FADc5'_btub-Suc2-nr_amt03-S106SAD-OeSAD-nr-FADc3'.

Primary transformants were selected on plates containing sucrose as a sole carbon source. Individual transformants were clonally purified and grown under standard lipid production conditions at pH 7.0, similar to the conditions as disclosed in Example 1. Fatty acid profiles were analyzed using standard fatty acid methyl ester gas chromatography flame ionization (FAME GC/FID) detection methods as described in Example 11. The resulting fatty acid profiles from a set of representative clones arising from the transformations of the transformation vector are shown in Table 60. Fatty acid profiles of lipids obtained from the untransformed strain C strain grown under lipid production conditions comprising glucose as a sole carbon source (pH 5.0) are additionally presented in Table 60.

TABLE 60

Fatty acid profiles of *Prototheca moriformis* (UTEX 1435) multiply engineered to knockout endogenous FADc alleles and to express an *O. europaea* stearoyl-ACP desaturase.

| Strain | Transformant | % C16:0 | % C18:0 | % C18:1 | % C18:2 |
|---|---|---|---|---|---|
| strain C | untransformed | 28.50 | 3.72 | 57.70 | 7.04 |
| strain C | untransformed | 28.57 | 3.69 | 57.61 | 7.07 |
| strain C | Transformant 1 | 20.37 | 1.13 | 74.38 | 0.01 |
| pSZ1499 | Transformant 2 | 19.98 | 1.16 | 74.60 | 0.00 |
| | Transformant 3 | 20.10 | 1.16 | 74.70 | 0.00 |
| | Transformant 4 | 21.13 | 1.21 | 73.86 | 0.00 |
| | Transformant 5 | 19.95 | 1.11 | 74.58 | 0.00 |
| | Transformant 6 | 20.20 | 1.14 | 74.61 | 0.00 |
| | Transformant 7 | 20.72 | 1.15 | 74.15 | 0.00 |
| | Transformant 8 | 20.06 | 1.11 | 74.44 | 0.00 |
| | Transformant 9 | 19.86 | 1.18 | 74.88 | 0.00 |

As shown in Table 60, transformation of strain C with pSZ1499 impacts the fatty acid profiles of the transformed microbes. The untransformed *Prototheca moriformis* (UTEX 1435) strain C strain exhibits a fatty acid profile comprising less than 60% C18:1 fatty acids and greater than 7% C18:2 fatty acids. In contrast, strain C strains transformed with pSZ1499 exhibited fatty acid profiles with an increased composition of C18:1 fatty acids and a concomitant decrease in C18:0 and C18:2 fatty acids. C18:2 fatty acids were undetected in the fatty acid profiles of strain C transformed with pSZ1499. The absence of detectable C18:2 fatty acids in pSZ1499 transformants indicated that the transformation with pSZ1499, bearing homologous recombination targeting sequences for integration into multiple FADc genomic loci, had abolished FAD activity.

Figure 3:
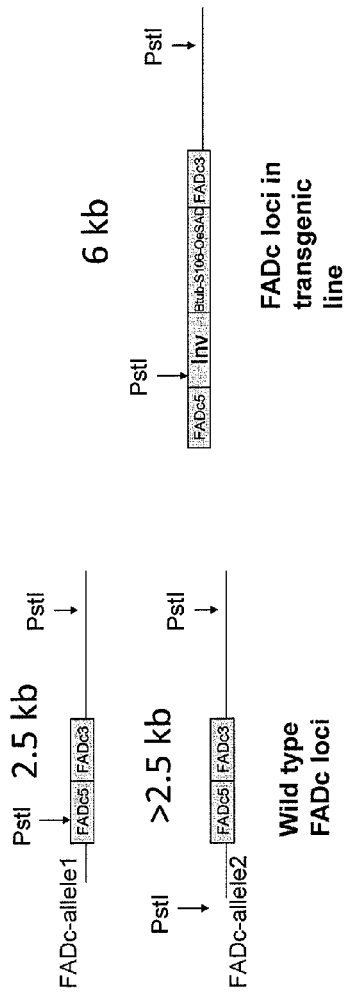
FIG. 3 shows PstI restriction maps of *Prototheca moriformis* FADc alleles with and without a targeted gene disruption, as described in Example 18.
Figure 4:
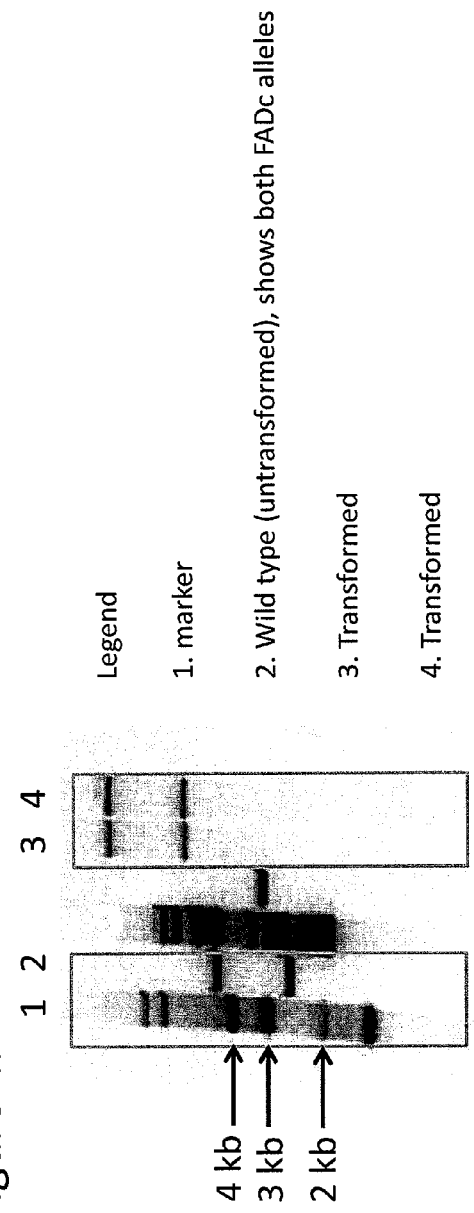
FIG. 4 shows the results of the Southern blot described in Example 18.

Southern blot analysis was conducted to verify that multiple FADc alleles were interrupted by the pSZ1499 transformation vector. Genomic DNA was extracted from strain C and pSZ1499 transformants using standard molecular biology methods. DNA from each sample was run on 0.8% agarose gels after digestion with the restriction enzyme PstI. DNA from this gel was transferred onto a Nylon+ membrane (Amersham), which was then hybridized with a P32-labeled polynucleotide probe corresponding to FADc 3' region. FIG. 3 shows maps of the pSZ1499 transformation cassette, the two sequenced FADc alleles of *Prototheca moriformis* (UTEX 1435), and the predicted sizes of the alleles disrupted by the pSZ1499 transformation vector. FADc allele 1 comprises a PstI restriction site, whereas FADc allele 2 does not. Integration of the SAD cassette would introduce a PstI restriction site into the disrupted FADc allele, resulting in a ~6 kb fragment resolved on the Southern, regardless of which allele was disrupted. FIG. 4 shows the results of Southern blot analysis. A hybridization band at ~6 kb is detected in both transformants. No smaller hybridization bands, that would be indicative of uninterrupted alleles, were detected. These results indicate that both FADc alleles were disrupted by pSZ1499.

The ablation of both alleles of the FADc fatty acid desaturase with a SAD expression cassette results in fatty acid profiles comprising about 74% C18:1. Collectively, these data demonstrate the utility and effectiveness of polynucleotides permitting knockout of FAD alleles and concomitant exogenous expression of stearoyl-ACP desaturase enzymes to alter the fatty acid profile of engineered microorganisms.

Example 19

Characteristics of Processed Oil Produced from Engineered Microorganisms

Methods and effects of transforming *Prototheca moriformis* (UTEX 1435) with transformation vector pSZ1500 (SEQ ID NO: 250) have been previously described in PCT Application Nos. PCT/US2011/038463 and PCT/US2011/038463.

A classically mutagenized (for higher oil production) derivative of *Protheca moriformis* (UTEX 1435), strain C, was transformed with the transformation construct pSZ1500 according to biolistic transformation methods detailed in Example 2. Primary transformants were selected on agar plates containing sucrose as a sole carbon source, clonally purified, and a single engineered line, strain D was selected for analysis. Strain D was grown as described herein. Hexane extraction of the oil from the generated biomass was then performed using standard methods, and the resulting triglyceride oil was determined to be free of residual hexane. Other methods of extraction of oil from microalgae using an expeller press are described in PCT Application No. PCT/US2010/31108 and are hereby incorporated by reference.

Oil extracted from biomass of strain D was then refined, bleached, and deodorized using well known vegetable oil processing methods. These procedures generated an oil sample, RBD469, which was subjected to a number of analytical testing protocols according to methods defined through the American Oil Chemists' Society, the American Society for Testing and Materials, and the International Organization for Standardization. The results of these analyses are summarized below in Table 60.

TABLE 60

Analytical results for oil sample RBD469.

| Method Number | Test Description | Results | Units |
|---|---|---|---|
| AOCS Ca 3a-46 | Insoluble impurities | <0.01 | % |
| AOCS Ca 5a-40 | Free Fatty Acids (Oleic) | 0.02 | % |
| AOCS Ca 5a-40 | Acid Value | 0.04 | mg KOH/g |
| AOCS CA 9f-57 | Neutral oil | 98.9 | % |
| D97 | Cloud Point | −15 | deg C. |
| D97 | Pour Point | −18 | deg C. |
|  | Karl Fischer Moisture | 0.01 | % |
| AOCS Cc 13d-55 (modified) | Chlorophyll | <0.01 | ppm |
|  | Iodine Value | 78.3 | g I$_2$/100 g |
| AOCS Cd 8b-90 | Peroxide Value | 0.31 | meq/kg |
| ISO 6885 | p-Anisidine Value | 0.65 |  |
| AOCS Cc 18-80 | Dropping Melting point (Mettler) | 6.2 | deg C. |
| AOCS Cd 11d-96 | Tricylglicerides | 98.6 | % |
| AOCS Cd 11d-96 | Monoglyceride | <0.01 | % |
| AOCS Cd 11d-96 | Diglicerides | 0.68 | % |
| AOCS Cd 20-91 | Total Polar Compounds | 2.62 | % |
| IUPAC, 2.507 and 2.508 | Oxidized & Polymerized Tricylglicerides | 17.62 | % |
| AOCS Cc 9b-55 | Flash Point | 244 | deg C. |
| AOCS Cc 9a-48 | Smoke Point | 232 | deg C. |
| AOCS Cd 12b-92 | Oxidataive Stability Index Rancimat (110° C.) | 31.6 | hours |
| AOCS Ca 6a-40 | Unsaponified Matter | 2.28 | % |

The same lot of *Prototheca moriformis* strain D RBD469 oil was analyzed for trace element content, solid fat content, and Lovibond color according to AOCS methods. Results of these analyses are presented below in Table 61, Table 62, and Table 63.

TABLE 61

ICP Elemental Analysis of RBD469 oil.

| Method Number | Test Description | Results in ppm |
|---|---|---|
| AOCS Ca 20-99 and AOCS Ca 17-01 (modified) | Phosphorus | 1.09 |
|  | Calcium | 0.1 |
|  | Magnesium | 0.04 |
|  | Iron | <0.02 |
|  | Sulfur | 28.8 |
|  | Copper | <0.05 |
|  | Potassium | <0.50 |
|  | Sodium | <0.50 |
|  | Silicon | 0.51 |
|  | Boron | 0.06 |
|  | Aluminum | <0.20 |
|  | Lead | <0.20 |
|  | Lithium | <0.02 |
|  | Nickel | <0.20 |
|  | Vanadium | <0.05 |
|  | Zinc | <0.02 |
|  | Arsenic | <0.20 |

TABLE 61-continued

ICP Elemental Analysis of RBD469 oil.

| Method Number | Test Description | Results in ppm |
|---|---|---|
|  | Mercury | <0.20 |
|  | Cadmium | <0.03 |
|  | Chromium | <0.02 |
|  | Manganese | <0.05 |
|  | Silver | <0.05 |
|  | Titanium | <0.05 |
|  | Selenium | <0.50 |
| UOP779 | Chloride organic | <1 |
| UOP779 | Chloride inorganic | 7.24 |
| AOCS Ba 4e-93 | Nitrogen | 6.7 |

TABLE 62

Solid Fat Content of RBD469 Oil

| Method Number | Solid Fat Content | Result |
|---|---|---|
| AOCS Cd 12b-93 | Solid Fat Content 10° C. | 0.13% |
| AOCS Cd 12b-93 | Solid Fat Content 15° C. | 0.13% |
| AOCS Cd 12b-93 | Solid Fat Content 20° C. | 0.28% |
| AOCS Cd 12b-93 | Solid Fat Content 25° C. | 0.14% |
| AOCS Cd 12b-93 | Solid Fat Content 30° C. | 0.08% |
| AOCS Cd 12b-93 | Solid Fat Content 35° C. | 0.25% |

TABLE 63

Lovibond Color of RBD469 Oil

| Method Number | Color | Result | Unit |
|---|---|---|---|
| AOCS Cc 13j-97 | red | 2 | unit |
| AOCS Cc 13j-97 | yellow | 27 | unit |

RBD469 oil was subjected to transesterification to produce fatty acid methyl esters (FAMEs). The resulting fatty acid methyl ester profile of RBD469 is shown in Table 64:

TABLE 64

Fatty acid methylester Profile of RBD469 Oil

| Fatty Acid | Area % |
|---|---|
| C10 | 0.01 |
| C12:0 | 0.04 |
| C14:0 | 0.64 |
| C15:0 | 0.08 |
| C16:0 | 8.17 |
| C16:1 iso | 0.39 |
| C16:1 | 0.77 |
| C17:0 | 0.08 |
| C18:0 | 1.93 |
| C18:1 | 85.88 |
| C18:1 | 0.05 |
| C18:2 | 0.05 |
| C20:0 | 0.3 |
| C20:1 | 0.06 |
| C20:1 | 0.44 |
| C22:0 | 0.11 |
| C23:0 | 0.03 |
| C24:0 | 0.1 |
| Total FAMEs Identified | 99.13 |

Example 20

Engineered Microalgae with Altered Fatty Acid Profiles

As described above, integration of heterologous genes to knockout or knockdown specific endogenous lipid pathway enzymes in *Prototheca* species can alter the fatty acid profiles of the engineered microbe. In this example, plasmid constructs were created to assess whether the lipid profile of a host cell can be affected as a result of a knockout or knockdown of an endogenous fatty acyl-ACP thioesterase gene, FATA1.

A. Altering Lipid Profiles by Knockout of an Endogenous *Prototheca moriformis* Thioesterase Gene A classically mutagenized (for higher oil production) derivative of *Protheca moriformis* UTEX 1435, strain A, was transformed with one of the following plasmid constructs in Table 65 using the methods of Example 2. Each construct contained a region for integration into the nuclear genome to interrupt the endogenous FATA1 gene and a *S. cerevisiae* suc2 sucrose invertase coding region under the control of *C. reinhardtii* β-tubulin promoter/5'UTR and *Chlorella vulgaris* nitrate reductase 3' UTR. This *S. cerevisiae* suc2 expression cassette is listed as SEQ ID NO: 159 and served as a selection marker. All protein coding regions were codon optimized to reflect the codon bias inherent in *Prototheca moriformis* UTEX 1435 nuclear genes in accordance with Table 2. Relevant sequences for the targeting regions for the FATA1 gene used for nuclear genome integration are shown below.

| Description | SEQ ID NO: |
|---|---|
| 5' sequence for integration into FATA1 locus | SEQ ID NO: 251 |
| 3' sequence for integration into FATA1 locus | SEQ ID NO: 252 |

TABLE 65

Plasmid constructs used to transform *Protheca moriformis* (UTEX 1435) strain A.

| Plasmid Construct | Sequence Elements |
|---|---|
| 1 | FATA1-CrbTub_yInv_nr-FATA1 |
| 2 | FATA1-CrbTub_yInv_nr::amt03_CwTE2_nr-FATA1 |

Relevant restriction sites in the construct FATA1-CrbTub_yInv_nr-FATA1 (SEQ ID NO: 253) are indicated in lowercase, bold and underlining and are 5'-3' BspQ 1, Kpn I, Asc I, Mfe I, Sac I, BspQ I, respectively. BspQI sites delimit the 5' and 3' ends of the transforming DNA. Bold, lowercase sequences represent genomic DNA from strain A that permit targeted integration at FATA1 locus via homologous recombination. Proceeding in the 5' to 3' direction, the *C. reinhardtii* β-tubulin promoter driving the expression of the yeast sucrose invertase gene (conferring the ability of strain A to metabolize sucrose) is indicated by boxed text. The initiator ATG and terminator TGA for invertase are indicated by uppercase, bold italics while the coding region is indicated in lowercase italics. The *Chlorella vulgaris* nitrate reductase 3' UTR is indicated by lowercase underlined text followed by the strain A FATA1 genomic region indicated by bold, lowercase text:

```
gctcttcggagtcactgtgccactgagttcgactggtagctgaatggagtcgctgctccactaaacgaattgtcagcaccgcca
gccggccgaggacccgagtcatagcgagggtagtagcgcgccatggcaccgaccagcctgcttgccagtactggcgtctcttc
cgcttctctgtggtcctctgcgcgctccagcgcgtgcgcttttccggtggatcatgcggtccgtggcgcaccgcagcggccgctg
cccatgcagcgccgctgcttccgaacagtggcggtcagggccgcacccgcggtagccgtccgtccggaacccgcccaagagt
tttgggagcagcttgagccctgcaagatggcggaggacaagcgcatcttcctggaggagcaccggtgcgtggaggtccgggg
ctgaccggccgtcgcattcaacgtaatcaatcgcatgatgatcagaggacacgaagtcttggtggcggtggccagaaacact
gtccattgcaagggcatagggatgcgttccttcacctctcatttctcatttctgaatccctccctgctcactctttctcctcctccttc
ccgttcacgcagcattcggggtaccctttcttgcgctatgacacttccagcaaaaggtagggcgggctgcgagacggcttcccggc
gctgcatgcaacaccgatgatgcttcgaccccccgaagctccttcggggctgcatgggcgctccgatgccgctccagggcgagcgc
tgtttaaatagccaggcccccgattgcaaagacattatagcgagctaccaaagccatattcaaacacctagatcactaccacttctacac
aggccactcgagcttgtgatcgcactccgctaagggggcgcctcttcctcttcgtttcagtcacaacccgcaaagggcgcgccATG
ctgctgcaggccttcctgttcctgctggccggcttcgccgccaagatcagcgcctccatgacgaacgagacgtccgaccgcccct
ggtgcacttcaccccaacaagggctggatgaacgaccccaacggcctgtggtacgacgagaaggacgccaagtggcacctgt
acttccagtacaacccgaacgacaccgtctggggggacgcccttgttctggggcacgccacgtccgacgacctgaccaactggg
aggaccagccatcgccatcgccccgaagcgcaacgactccggcgccttctccggctccatggtggtggactacaacaacacct
ccggcttcttcaacgacaccatcgacccgcgccagcgctgcgtggccatctggacctacaacacccgggagtccgaggagcagt
acatctcctacagcctggacggcggctacacccttcaccgagtaccagaagaaccccgtgctggccgccaactccacccagttcc
gcgacccgaaggtcttctggtacgagccctcccagaagtggatcatgaccgcggccaagtcccaggactacaagatcgagatct
actcctccgacgacctgaagtcctggaagctggagtccgcgttcgccaacgagggcttcctcggctaccagtacgagtgccccgg cctgatcgaggtccccaccgagcaggaccccagcaagtcctactgggtgatgttcatctccatcaacccggcgccccggccgg
cggctccttcaaccagtacttcgtcggcagcttcaacggcacccacttcgaggccttcgacaaccagtcccgcgtggtggacttcg
gcaaggactactacgccctgcagaccttcttcaacaccgacccgacctacgggagcgccctgggcatcgcgtgggcctccaact
gggagtactccgccttcgtgccaccaaccctggcgctcctccatgtccctcgtgcgcaagttctccctcaacaccgagtaccag
gccaacccggagacggagctgatcaacctgaaggccgagccgatcctgaacatcagcaacgccggccctggagccggttcg
ccaccaacaccacgttgacgaaggccaacagctacaacgtcgacctgtccaacagcaccggcaccctggagttcgagctggtg
tacgccgtcaacaccaccagacgatctccaagtccgtgttcgcggacctctccctctggttcaagggcctggaggaccccgagg
agtacctccgcatgggcttcgaggtgtccgcgtcctccttcttcctggaccgcgggaacagcaaggtgaagttcgtgaaggagaa
cccctacttcaccaaccgcatgagcgtgaacaaccagcccttcaagagcgagaacgacctgtcctactacaaggtgtacggcttg
ctggaccagaacatcctggagctgtacttcaacgacggcgacgtcgtgtccaccaacacctacttcatgaccaccgggaacgcc
ctgggctccgtgaacatgacgacgggggtggacaacctgttctacatcgacaagttccaggtgcgcgaggtcaagTGAcaatt
ggcagcagcagctcggatagtatcgacacactctggacgctggtcgtgtgatggactgttgccgccacacttgctgccttgacctgtga
atatccctgccgcttttatcaaacagcctcagtgtgtttgatcttgtgtgtacgcgcttttgcgagttgctagctgcttgtgctatttgcaata
ccacccccagcatcccttccctcgtttcatatcgcttgcatcccaaccgcaacttatctacgctgtcctgctatccctcagcgctgctcct
gctcctgctcactgccctcgcacagccttggtttgggctccgcctgtattctcctggtactgcaacctgtaaaccagcactgcaatgctg
atgcacgggaagtagtgggatgggaacacaaatggaggatcgtagagctcactagtatcgatttcgaagacagggtggttggctgg
atggggaaacgctggtcgcgggattcgatcctgctgcttatatcctccctggaagcacaccacgactctgaagaagaaacg
tgcacacacacaacccaaccggccgaatatttgcttccttatcccgggtccaagagagactgcgatgcccccctcaatcagcat
cctcctccctgccgcttcaatcttccctgcttgcctgcgccgcgggtgcgccgtctgcccgcccagtcagtcactcctgcacaggc
cccttgtgcgcagtgctcctgtaccctttaccgctccttccattctgcgaggcccctattgaatgtattcgttgcctgtgtggcca
agcgggctgctgggcgcgccgcgtcgggcagtgctcggcgactttggcggaagccgattgttcttctgtaagccacgcgcttg
ctgctttgggaagagaagggggggggtactgaatggatgaggaggagaaggagggtattggtattatctgagttgggtgaa
gagc
```

To introduce the *Cuphea wrightii* ACP-thioesterase 2 (CwTE2) gene (Accession No: U56104) into at the FATA1 locus of strain A, a construct was generated to express the protein coding region of the CwTE2 gene under the control of the *Prototheca moriformis* Amt03 promoter/5'UTR (SEQ ID NO: 89) and *C. vulgaris* nitrate reductase 3'UTR. The construct that has been expressed in strain A can be written as FATA1-CrbTub_yInv_nr::amt03_CwTE2_nr-FATA1 (SEQ ID NO: 254).

Relevant restriction sites in the construct FATA1-CrbTub_yInv_nr::amt03_CwTE2_nr-FATA1 are indicated in lowercase, bold and underlining and are 5'-3' BspQ 1, Kpn I, Asc I, Mfe I, BamH I, EcoR I, Spe I, Asc I, Pac I, Sac I, BspQ I, respectively. BspQI sites delimit the 5' and 3' ends of the transforming DNA. Bold, lowercase sequences represent genomic DNA from strain A that permit targeted integration at FATA1 locus via homologous recombination. Proceeding in the 5' to 3' direction, the *C. reinhardtii* β-tubulin promoter driving the expression of the yeast sucrose invertase gene (conferring the ability of strain A to metabolize sucrose) is indicated by boxed text. The initiator ATG and terminator TGA for invertase are indicated by uppercase, bold italics while the coding region is indicated in lowercase italics. The *Chlorella vulgaris* nitrate reductase 3' UTR is indicated by lowercase underlined text followed by an endogenous Amt03 promoter of *Prototheca moriformis*, indicated by boxed italics text. The Initiator ATG and terminator TGA codons of the *C. wrightii* ACP-thioesterase are indicated by uppercase, bold italics, while the remainder of the ACP-thioesterase coding region is indicated by bold italics. The *C. vulgaris* nitrate reductase 3' UTR is again indicated by lowercase underlined text followed by the strain A FATA1 genomic region indicated by bold, lowercase text:

gctcttcggagtcactgtgccactgagttcgactggtagctgaatggagtcgctgctccactaaacgaattgtcagcaccgcca
gccggccgaggacccgagtcatagcgagggtagtagcgcgccatggcaccgaccagcctgcttgccagtactggcgtctcttc
cgcttctctgtggtcctctgcgcgctccagcgcgtgcgcttttccggtggatcatgcggtccgtggcgcaccgcagcggccgctg
cccatgcagcgccgctgcttccgaacagtggcggtcagggccgcaccgcgggtagccgtccgtccggaacccgcccaagagt
tttgggagcagcttgagccctgcaagatggcggaggacaagcgcatcttcctggaggagcaccggtgcgtggaggtccgggg
ctgaccggccgtcgcattcaacgtaatcaatcgcatgatgatcagaggacacgaagtcttggtggcggtggccagaaacact
gtccattgcaagggcataggggatgcgttccttcacctctcatttctcatttctgaatccctccctgctcactctttctcctcctcttc
ccgttcacgcagcattcggggtacc ctttcttgcgctatgacacttccagcaaaaggtagggcgggctgcgagacggcttcccggc
gctgcatgcaacaccgatgatgcttcgaccccgaagctccttcggggctgcatgggcgctccgatgccgctcagggcgagcgc
tgtttaaatagccaggcccccgattgcaaagacattatagcgagctaccaaagccatattcaaacacctagatcactaccacttctacac
aggccactcgagcttgtgatcgcactccgctaagggggcgcctcttcctcttcgtttcagtcacaacccgcaaac ggcgcgccATG
ctgctgcaggccttcctgttcctgctggccggcttcgccgccaagatcagcgcctccatgacgaacgagacgtccgaccgcccct
ggtgcacttcaccccaacaagggctggatgaacgaccccaacggcctgtggtacgacgagaaggacgccaagtggcacctgt
acttccagtacaacccgaacgacaccgtctggggacgcccttgttctggggccacgccacgtccgacgacctgaccaactggg
aggaccagcccatcgccatcgccccgaagcgcaacgactccggcgcgcttctccggctccatggtggtggactacaacaacacct
ccggcttcttcaacgacaccatcgaccgcgccagcgctgcgtggccatctggacctacaacacccggagtccgaggagcagt
acatctcctacagcctggacggcggctacaccttcaccgagtaccagaagaacccgtgctggccgccaactccacccagttcc
gcgacccgaaggtcttctggtacgaccctcccagaagtggatcatgaccgcggcaagtcccaggactacaagatcgagatct
actcctccgacgacctgaagtcctggaagctggagtccgcgttcgccaacgagggcttcctcggctaccagtacgagtgcccgg
cctgatcgaggtccccaccgagcaggacccagcaagtcctactgggtgatgttcatctccatcaacccccggcgccccggccgg cggctccttcaaccagtacttcgtcggcagcttcaacggcacccacttcgaggccttcgacaaccagtcccgcgtggtggacttcg
gcaaggactactacgccctgcagaccttcttcaacaccgacccgacctacgggagcgccctgggcatcgcgtgggcctccaact
gggagtactccgccttcgtgccaccaacccctggcgctcctccatgtccctcgtgcgcaagttctccctcaacaccgagtaccag
gccaacccggagacggagctgatcaacctgaaggccgagccgatcctgaacatcagcaacgccggccctggagccggttcg
ccaccaacaccacgttgacgaaggccaacagctacaacgtcgacctgtccaacagcaccggcaccctggagttcgagctggtg
tacgccgtcaacaccacccagacgatctccaagtccgtgttcgcggacctctccctctggttcaagggcctggaggaccccgagg
agtacctccgcatgggcttcgaggtgtccgcgtcctccttcttcctggaccgcgggaacagcaaggtgaagttcgtgaaggagaa
cccctacttcaccaaccgcatgagcgtgaacaaccagcccttcaagagcgagaacgacctgtcctactacaaggtgtacggcttg
ctggaccagaacatcctggagctgtacttcaacgacgcgacgtcgtgtccaccaacacctacttcatgaccaccgggaacgcc
ctgggctccgtgaacatgacgacggggtggacaacctgttctacatcgacaagttccaggtgcgcgaggtcaagTGAcaatt
ggcagcagcagctcggatagtatcgacacactctggacgctggtcgtgtgatggactgttgccgccacacttgctgccttgacctgtga
atatccctgccgcttttatcaaacagcctcagtgtgtttgatcttgtgtgtacgcgcttttgcgagttgctagctgcttgtgctatttgcgaata
ccaccccagcatcccttcctcgtttcatatcgcttgcatcccaaccgcaacttatctacgctgtcctgctatccctcagcgctgctcct
gctcctgctcactgccctcgcacagccttggtttgggctccgcctgtattctcctggtactgcaacctgtaaaccagcactgcaatgctg
atgcacgggaagtagtgggatgggaacacaaatggaggatcccgcgtctcgaacagagcgcgcagaggaacgctgaaggtctcg
cctctgtcgcacctcagcgcggcatacaccacaataaccacctgacgaatgcgcttggttcttcgtccattagcgaagcgtccggttca
cacacgtgccacgttggcgaggtggcaggtgacaatgatcggtggagctgatggtcgaaacgttcacagcctagggatatcgaattc
ggccgacaggacgcgcgtcaaaggtgctggtcgtgtatgccctggccggcaggtcgttgctgctgctggttagtgattccgcaacc
ctgatttttggcgtcttattttggcgtggcaaacgctggcgcccgcgagccggccggcggcgatgcggtgccccacggctgccgg
aatcaagggaggcaagagcgcccgggtcagttgaagggcttacgcgcaaggtacagccgctcctgcaaggctgcgtggtgg
aattggacgtgcaggtcctgctgaagttcctccaccgcctccaccagcggacaaagcaccggtgtatcaggtccgtgtcatccactc
taaagagctcgactacgacctactgatggcccagattcttcatcaaaaacgcctgagacacttgcccaggattgaaactccctga
agggaccaccaggggccctgagttgttccttccccgtggcgagctgccagccaggctgtacctgtgatcgaggctggcggga
aaataggcttcgtgtgctcaggtcatggaggtgcaggacagctcatgaaacgccaacaatgcgcacaattcatgtcaagctaatc
agctatttcctcttcacgagctgtaattgtcccaaaattctggtctaccggggtgatccttcgtgtacgggcccttccctcaaccctag
gtatgcgcgcatgcggtcgccgcgcaactcgcgcgagggccgagggtttgggacgggccgtcccgaaatgcagttgcacccgg
atgcgtggcaccttttttgcgataatttatgcaatgcaatgactgctctgcaaaattctggctctgtcgccaaccctaggatcagcggcgtag
gatttcgtaatcattcgtcctgatggggagctaccgactaccctaatatcagcccgactgcctgacgccagcgtccacttttgtgcac
acattccattcgtgcccaagacatttcattgtggtgcgaagcgtccccagttacgctcacctgtttcccgacctccttactgttctgtcg
acagagcgggcccacaggccggtcgcagcc ctagtatggtggtggccgccgccgccagcagcgccttcttccccgtgcccgc

```
ccccgccccaccccaagcccggcaagttcggcaactggcccagcagcctgagccagcccttcaagcccaagagcaaccc
aacggccgcttccaggtgaaggccaacgtgagccccacgggcgcgcccccaaggccaacggcagcgccgtgagcctgaag
tccggcagcctgaacaccctggaggaccccccagcagccccccccccgcacctcctgaaccagctgcccgactggagccg
cctgcgcaccgccatcaccaccgtgttcgtggccgccgagaagcagttcaccgcctggaccgcaagagcaagcgccccgaca
tgctggtggactggttcggcagcgagaccatcgtgcaggacggcctggtgttccgcgagcgcttcagcatccgcagctacgagat
cggcgccgaccgcaccgccagcatcgagaccctgatgaaccacctgcaggacaccagcctgaaccactgcaagagcgtggg
cctgctgaacgacggcttcggccgcaccccgagatgtgcacccgcgacctgatctgggtgctgaccaagatgcagatcgtggtg
aaccgctaccccacctggggcgacaccgtggagatcaacagctggttcagccagagcggcaagatcggcatgggccgcagt
ggctgatcagcgactgcaacaccggcgagatcctggtgcgcgccaccagcgcctgggccatgatgaaccagaagacccgccg
cttcagcaagctgccctgcgaggtgcgccaggagatcgccccccacttcgtggacgccccccccgtgatcgaggacaacgacc
gcaagctgcacaagttcgacgtgaagaccggcgacagcatctgcaagggcctgaccccggctggaacgacttcgacgtgaac
cagcacgtgagcaacgtgaagtacatcggctggattctggagagcatgcccaccgaggtgctggagacccaggagctgtgcag
cctgaccctggagtaccgccgcgagtgcggccgcgagagcgtggtggagagcgtgaccagcatgaacccagcaaggtgggc
gaccgcagccagtaccagcacctgctgcgcctggaggacggcgccgacatcatgaagggccgcaccgagtggcgccccaag
```

```
aacgccggcaccaaccgcgccatcagcaccTGAttaattaactcgaggcagcagcagctcggatagtatcgacacactcgga
cgctggtcgtgtgatggactgttgccgccacacttgctgccttgacctgtgaatatccctgccgcttttatcaaacagcctcagtgtgtttg
atcttgtgtgtacgcgcttttgcgagttgctagctgcttgtgctatttgcgaataccaccccagcatcccttccctcgttcatatcgcttg
catcccaaccgcaacttatctacgctgtcctgctatccctcagcgctgctcctgctcctgctcactgccctcgcacagccttggtttggg
ctccgcctgtattctcctggtactgcaacctgtaaaccagcactgcaatgctgatgcacgggaagtagtgggatgggaacacaaatgg
aaagcttgagctcttgttttccagaaggagttgctccttgagcctttcattctcagcctcgataacctccaaagccgctctaattgtggagg
gggttcgaagacagggtggttggctggatggggaaacgctggtcgcgggattcgatcctgctgcttatatcctccctggaagca
cacccacgactctgaagaagaaaacgtgcacacacacaaccccaaccggccgaatatttgcttccttatcccgggtccaagag
agactgcgatgcccccctcaatcagcatcctcctccctgccgcttcaatcttccctgcttgcctgcgcccgcggtgcgccgtctgc
ccgcccagtcagtcactcctgcacaggcccttgtgcgcagtgctcctgtacccttaccgctccttccattctgcgaggccccct
attgaatgtattcgttgcctgtgtggccaagcgggctgctgggcgcgccgccgtcgggcagtgctcggcgactttggcggaagc
cgattgttcttctgtaagccacgcgcttgctgctttgggaagagaaggggggggtactgaatggatgaggaggagaaggag
gggtattggtattatctgagttgggtgaagagc
```

Upon individual transformation of plasmid construct 1 or 2 into strain A, positive clones were selected on agar plates comprising sucrose as the sole carbon source. As in the previous examples, primary transformants were clonally purified and grown under standard lipid production conditions at pH 7 and lipid samples were prepared from dried biomass from each transformant. Fatty acid profiles were determined using direct transesterification methods as described in Example 11. The resulting fatty acid profiles (expressed as Area % of total fatty acids) from a set of representative clones arising from transformations with construct 1 as compared to those of untransformed strain A controls are presented in Table 66. The resulting fatty acid profiles (expressed as Area % of total fatty acids) from a set of representative clones arising from transformations with construct 2 as compared to those of untransformed strain A controls are presented in Table 67.

TABLE 66

Fatty acid profiles of *Prototheca moriformis* cells comprising a selectable marker to disrupt an endogenous FATA1 allele.

| Transformation | % C14:0 | % C16:0 | % C18:0 | % C18:1 | % C18:2 |
|---|---|---|---|---|---|
| Wildtype | 1.23 | 25.68 | 2.83 | 60.54 | 7.52 |
| Transformant 1 | 0.86 | 16.95 | 1.75 | 68.44 | 9.78 |

TABLE 66-continued

Fatty acid profiles of *Prototheca moriformis* cells comprising a selectable marker to disrupt an endogenous FATA1 allele.

| Transformation | % C14:0 | % C16:0 | % C18:0 | % C18:1 | % C18:2 |
|---|---|---|---|---|---|
| Transformant 2 | 0.85 | 17.33 | 1.71 | 68.57 | 9.31 |
| Transformant 3 | 0.82 | 17.40 | 1.78 | 68.55 | 9.22 |
| Transformant 4 | 0.84 | 17.43 | 1.78 | 68.25 | 9.53 |
| Transformant 5 | 0.75 | 17.64 | 2.02 | 69.02 | 8.61 |

Results presented in Table 66 show that ablation of the host's endogenous FATA1 allele alters the fatty acid profile of the engineered microalgae. The impact of targeting a selectable marker to the endogenous FATA1 allele on the fatty acid profile of the transformed microbe is a clear diminution of C16:0 fatty acids with concomitant increase in C18:1 fatty acids.

TABLE 67

Fatty acid profiles of *Prototheca moriformis* cells containing a selectable marker and an exogenous thioesterase to disrupt an endogenous FATA1 allele.

| | Transformant | Carbon source | % C10:0 | % C12:0 | % C14:0 | % C16:0 | % C18:0 | % C18:1 | % C18:2 |
|---|---|---|---|---|---|---|---|---|---|
| strain A | Wildtype | Glucose | 0.01 | 0.04 | 1.38 | 28.83 | 3.00 | 56.05 | 8.21 |
| | Wildtype | Glucose | 0.01 | 0.04 | 1.50 | 29.38 | 3.00 | 55.29 | 8.23 |
| | Wildtype | Glucose/Fructose | 0.01 | 0.05 | 1.48 | 28.58 | 3.20 | 57.14 | 7.27 |
| | Wildtype | Glucose/Fructose | 0.01 | 0.04 | 1.54 | 29.05 | 3.23 | 56.47 | 7.32 |
| >2 copies | 1 | Glucose/Fructose | 4.29 | 19.98 | 9.17 | 20.68 | 3.47 | 34.38 | 6.37 |
| | 2 | Glucose/Fructose | 3.11 | 16.17 | 9.91 | 15.97 | 1.57 | 45.72 | 5.81 |
| | 3 | Sucrose | 4.84 | 24.22 | 11.56 | 19.48 | 2.67 | 29.56 | 6.02 |
| | 4 | Sucrose | 3.24 | 16.67 | 10.39 | 16.34 | 1.43 | 44.41 | 6.00 |
| 1-2 copies | 1 | Glucose/Fructose | 0.18 | 1.64 | 1.85 | 14.43 | 2.12 | 70.30 | 7.63 |
| | 2 | Glucose/Fructose | 0.18 | 1.56 | 1.74 | 13.56 | 2.25 | 71.04 | 7.72 |
| | 3 | Sucrose | 0.19 | 1.69 | 1.89 | 13.79 | 3.15 | 69.97 | 7.68 |
| | 4 | Sucrose | 0.15 | 1.26 | 1.49 | 13.44 | 2.73 | 71.46 | 7.77 |

Concordant with targeting a selectable marker alone to the host's FATA1 allele, integration of a selectable marker concomitant with an exogenous thioesterase results in an alteration of the fatty acid profile of the engineered microalgae. As shown in Table 67 above, targeting an exogenous thioesterase gene to interrupt the FATA1 allele results in a clear diminution of C16:0 fatty acid production. The expression of the CwTE2 thioesterase at the FATA1 locus also impacts mid chain fatty acids and C18:1 fatty acid production to an extent that is dependent upon the level of exogenous thioesterase activity present in the transformants analyzed. There is good concordance between copy number of the amplified transgene at the target integration site and thioesterase levels as revealed either by impacts on fatty acid profiles or recombinant protein accumulation as assessed by Western blotting.

Transgenic lines in which the CwTE2 gene has undergone amplification show a marked increase in C10:0-C14:0 fatty acids and a concurrent decrease in C18:1 fatty acids. In contrast, those transformants in which CwTE2 has undergone little or no amplification are consistent with lower expression of the exogenous thioesterase, resulting in a slight increase in mid chain fatty acids and a far greater impact on the increase of C18:1 fatty acids.

Collectively, these data show that targeted disruption of the host's endogenous FATA1 allele alters the lipid profile of the engineered microalgae. These data demonstrate the utility and effectiveness of polynucleotides permitting targeted disruption of a FATA allele to alter the fatty acid profile of engineered microbial cells, in particular in decreasing the concentration of C16 fatty acids and increasing the concentration of C18:1 fatty acids. These data additionally demonstrate the utility and effectiveness of polynucleotides permitting targeted disruption of a FATA allele while concomitantly expressing an exogenous thioesterase to alter the fatty acid profile of engineered microbial cells, in particular in decreasing the concentration of C16 fatty acids.

B. Altering Lipid Profiles by Knockdown of an Endogenous *Prototheca moriformis* Thioesterase Gene A construct to down-regulate the *Prototheca moriformis* FATA1 gene expression by RNAi was introduced into a *Prototheca moriformis* UTEX 1435 strain A genetic background. The *Saccharomyces cerevisiae* suc2 sucrose invertase gene was utilized as a selectable marker, conferring the ability to grow on sucrose as a sole-carbon source. The construct utilized the first exon of the FatA1 coding region, followed by the endogenous intron, and a repeat unit of the first exon in the reverse orientation. 5' and 3' homologous recombination targeting sequences (flanking the construct) to the 6S genomic region, listed as SEQ ID NO: 82 and 84 respectively, were included for integration of the hairpin construct into the nuclear genome. This construct is designated 6S::β-Tub:suc2:nr::β-tub:hairpinFatA:nr::6S.

Relevant restriction sites in 6S::3-Tub:suc2:nr::β-tub:hairpin FatA:nr::6S are indicated in lowercase, bold and underlining and are 5'-3' BspQ 1, Kpn I, Mfe I, BamH I, EcoR I, Spe I, Xho I, Sac I, BspQ I, respectively. BspQI sites delimit the 5' and 3' ends of the transforming DNA. Bold, lowercase sequences represent genomic DNA from strain A that permit targeted integration at 6s locus via homologous recombination. Proceeding in the 5' to 3' direction, the *C. reinhardtii* β-tubulin promoter driving the expression of the yeast sucrose invertase gene (conferring the ability of strain A to metabolize sucrose) is indicated by boxed text. The initiator ATG and terminator TGA for invertase are indicated by uppercase, bold italics while the coding region is indicated in lowercase italics. The *Chlorella vulgaris* nitrate reductase 3' UTR is indicated by lowercase underlined text followed by the second *C. reinhardtii* β-tubulin promoter driving the expression of the Hairpin FatA1, indicated by boxed italics text. The Initiator ATG codon of the FatA1 is indicated by uppercase, bold italics, while the remainder of the first exon of FatA1 coding region is indicated by uppercase. The intron of the FatA gene is indicated as underlined uppercase, and a linker region shown in underlined uppercase, bold italics was created at the FatA1 intron/reversed first exon junction to aid in RNA splicing in these vectors. The inverted first exon of FatA1 is indicated by uppercase. The *C. vulgaris* nitrate reductase 3' UTR is again indicated by lowercase underlined text followed by the strain A 6S genomic region indicated by bold, lowercase text. The sequence of the FATA portions of this RNAi construct is listed as SEQ ID NO: 255.

```
gctcttcgccgccgccactcctgctcgagcgcgcccgcgcgtgcgccgccagcgccttggccttttcgccgcgctcgtgcgcgtc
gctgatgtccatcaccaggtccatgaggtctgccttgcgccggctgagccactgcttcgtccgggcggccaagaggagcatga
gggaggactcctggtccagggtcctgacgtggtcgcggctctgggagcgggccagcatcatctggctctgccgcaccgaggc
cgcctccaactggtcctccagcagccgcagtcgccgccgaccctggcagaggaagacaggtgagggggggtatgaattgtaca
gaacaaccacgagccttgtctaggcagaatccctaccagtcatggctttacctggatgacggcctgcgaacagctgtccagcg
accctcgctgccgccgcttctcccgcacgcttctttccagcaccgtgatgcgcgagccagcgccgcacgctggcgctgcgctt
cgccgatctgaggacagtcggggaactctgatcagtctaaaccccccttgcgcgttagtgttgccatcctttgcagaccggtgag
agccgacttgttgtgcgccaccccccacaccacctcctcccagaccaattctgtcaccttttt ggcgaaggcatcggcctcggcc
tgcagagaggacagcagtgcccagccgctggggg ttggcggatgcacgctcaggtaccctttcttgcgctatgacacttccagca
aaaggtagggcgggctgcgagacggcttcccggcgctgcatgcaacaccgatgatgcttcgaccccccgaagctccttcggggctg
catgggcgctccgatgccgctccagggcgagcgctgtttaaatagccaggcccccgattgcaaagacattatagcgagctaccaaag
ccatattcaaacacctagatcactaccacttctacacaggccactcgagcttgtgatcgcactccgctaaggggg cgcctcttcctcttc
gtttcagtcacaacccgcaaactctagaaatatcaATGctgctgcaggccttcctgttcctgctggccggcttcgccgccaagatcag
cgcctccatgacgaacgagacgtccgaccgcccctggtgcacttcaccccaacaagggctggatgaacgaccccaacggcc
tgtggtacgacgagaaggacgccaagtggcacctgtacttccagtacaacccgaacgacaccgtctgggggacgcccttgttctg
gggccacgccacgtccgacgacctgaccaactgggaggaccagcccatcgcatcgccccgaagcgcaacgactccggcgc
cttctccggctccatggtggtggactacaacaacacctccggcttcttcaacgacaccatcgacccgcgccagcgctgcgtggcca
tctggacctacaacaccccggagtccgaggagcagtacatctcctacagcctggacggcggctacaccttcaccgagtaccaga
gaaccccgtgctggccgccaactccaccagttccgcgacccgaaggtcttctggtacgagccctcccagaagtggatcatgac
cgcggccaagtcccaggactacaagatcgagatctactcctccgacgacctgaagtcctggaagctggagtccgcgttcgccaa
cgagggcttcctcggctaccagtacgagtgccccggcctgatcgaggtccccaccgagcaggacccagcaagtcctactgggt gatgttcatctccatcaaccccggcgcccgccggcggctccttcaaccagtacttcgtcggcagcttcaacggcacccacttcg
aggccttcgacaaccagtcccgcgtggtggacttcggcaaggactactacgccctgcagaccttcttcaacaccgacccgaccta
cgggagcgccctgggcatcgcgtgggcctccaactgggagtactccgccttcgtgccaccaaccctggcgctcctccatgtccc
tcgtgcgcaagttctccctcaacaccgagtaccaggccaacccggagacggagctgatcaacctgaaggccgagccgatcctg
aacatcagcaacgccgcccctggagccggttcgccaccaacaccacgttgacgaaggccaacagctacaacgtcgacctgtc
caacagcaccggcaccctggagttcgagctggtgtacgccgtcaacaccaccagacgatctccaagtccgtgttcgcggacctc
tccctctggttcaagggcctggaggaccccgaggagtacctccgcatgggcttcgaggtgtccgcgtcctccttcttcctggaccgc
gggaacagcaaggtgaagttcgtgaaggagaaccccctacttcaccaaccgcatgagcgtgaacaaccagcccttcaagagcg
agaacgacctgtcctactacaaggtgtacgcttgctggaccagaacatcctggagctgtacttcaacgacggcgacgtcgtgtcc
accaacacctacttcatgaccaccggggaacgccctgggctccgtgaacatgacgacgggggtggacaacctgttctacatcgac
aagttccaggtgcgcgaggtcaagTGAcaattggcagcagcagctcggatagtatcgacacactctggacgctggtcgtgtgat
ggactgttgccgccacacttgctgccttgacctgtgaatatccctgccgcttttatcaaacagcctcagtgtgtttgatcttgtgtgtacgcg
cttttgcgagttgctgctgcttgtgctatttgcgaataccacccccagcatcccctttccctcgtttcatatcgcttgcatcccaaccgcaac
ttatctacgctgtcctgctatccctcagcgctgctcctgctcctgctcactgcccctcgcacagccttggtttgggctccgcctgtattctcc
tggtactgcaacctgtaaaccagcactgcaatgctgatgcacgggaagtagtgggatgggaacacaaatggaggatccgcgtctcg
aacagagcgcgcagaggaacgctgaaggtctcgcctctgtcgcacctcagcgcggcatacaccacaataaccacctgacgaatgcg
cttggttcttcgtccattagcgaagcgtccggttcacacacgtgccacgttggcgaggtggcaggtgacaatgatcggtggagctgatg gtcgaaacgttcacagcctagggatatcgaattcctttcttgcgctatgacacttccagcaaaaggtagggcgggctgcgagacgg
cttcccggcgctgcatgcaacaccgatgatgcttcgaccccccgaagctccttcggggctgcatgggcgctccgatgccgctccag
ggcgagcgctgtttaaatagccaggcccccgattgcaaagacattatagcgagctaccaaagccatattcaaacacctagatca
ctaccacttctacacaggccactcgagcttgtgatcgcactccgctaaggggg cgcctcttcctcttcgtttcagtcacaacccgcaa
acactagtATGGCACCGACCAGCCTGCTTGCCAGTACTGGCGTCTCTTCCGCTTCTCT
GTGGTCCTCTGCGCGCTCCAGCGCGTGCGCTTTTCCGGTGGATCATGCGGTCCGT
GGCGCACCGCAGCGGCCGCTGCCCATGCAGCGCCGCTGCTTCCGAACAGTGGCG
GTCAGGGCCGCACCCGCGGTAGCCGTCCGTCCGGAACCCGCCCAAGAGTTTTGG
GAGCAGCTTGAGCCCTGCAAGATGGCGGAGGACAAGCGCATCTTCCTGGAGGAG
CACCGGTGCGTGGAGGTCCGGGCTGACCGGCCGTCGCATTCAACGTAATCAAT
CGCATGATGATCAGAGGACACGAAGTCTTGGTGGCGGTGGCCAGAAACACTGTC
CATTGCAAGGGCATAGGGATGCGTTCCTTCACCTCTCATTTCTCATTTCTGAATCC
CTCCCTGCTCACTCTTTCTCCTCCTCCTTCCCGTTCACGCAGCATTCGGGGCAACG
AGGTGGGCCCCGTGCTCCTCCAGGAAGATGCGCTTGTCCTCCGCCATCTTGCAGGG
CTCAAGCTGCTCCCAAAACTCTTGGGCGGGTTCCGGACGGACGGCTACCGCGGGT
GCGGCCCTGACCGCCACTGTTCGGAAGCAGCGGCGCTGCATGGGCAGCGGCCGC
TGCGGTGCGCCACGGACCGCATGATCCACCGGAAAAGCGCACGCGCTGGAGCGC
GCAGAGGACCACAGAGAAGCGGAAGAGACGCCAGTACTGGCAAGCAGGCTGGT
```

```
CGGTGCCATatcgatagatctcttaaggcagcagcagctcggatagtatcgacacactctggacgctggtcgtgtgatggact
gttgccgccacacttgctgccttgacctgtgaatatccctgccgcttttatcaaacagcctcagtgtgtttgatcttgtgtgtacgcgcttttg
cgagttgctagctgcttgtgctatttgcgaataccaccccagcatcccttccctcgtttcatatcgcttgcatcccaaccgcaacttatct
acgctgtcctgctatccctcagcgctgctcctgctcctgctcactgccctcgcacagccttggtttgggctccgcctgtattctcctggta
ctgcaacctgtaaaccagcactgcaatgctgatgcacgggaagtagtgggatgggaacacaaatggaaagcttaattaagagctctt
gttttccagaaggagttgctccttgagcctttcattctcagcctcgataacctccaaagccgctctaattgtggaggggggttcgaa
tttaaaagcttggaatgttggttcgtgcgtctggaacaagcccagacttgttgctcactgggaaaaggaccatcagctccaaaa
aacttgccgctcaaaccgcgtacctctgctttcgcgcaatctgccctgttgaaatgccaccacattcatattgtgacgcttgagc
agtctgtaattgcctcagaatgtggaatcatctgccccctgtgcgagcccatgccaggcatgtcgcgggcgaggacaccgcc
actcgtacagcagaccattatgctacctcacaatagttcataacagtgaccatatttctcgaagctccccaacgagcacctccat
gctctgagtggccaccccgggccctggtgcttgcggagggcaggtcaaccggcatggggctaccgaaatccccgaccggat
cccaccacccgcgatgggaagaatctctcccgggatgtgggcccaccaccagcacaacctgctggcccaggcgagcgtc
aaaccataccacacaaatatccttggcatcggccctgaattccttctgccgctctgctaccggtgcttctgtccgaagcagggg
ttgctagggatcgctccgagtccgcaaaccccttgtcgcgtggcggggcttgttcgagcttgaagagc
```

Expression of 6S::β-Tub:suc2:nr::β-tub:hairpin FatA:nr::6S leads to the formation of a hairpin RNA to silence the target FatA gene product. Upon transformation of the construct 6S::β-Tub:suc2:nr::β-tub:hairpin FatA:nr::6S into strain A, positive clones were selected on agar plates comprising sucrose as the sole carbon source. Primary transformants were clonally purified and grown under standard lipid production conditions at pH 5.0 and lipid samples were prepared from dried biomass from each transformant. Fatty acid profiles were determined using direct transesterification methods as described in Example 11. The resulting fatty acid profiles (expressed as Area % of total fatty acids) from a set of representative clones arising from transformations as compared to those of an untransformed strain A control are presented in Table 68.

TABLE 68

Fatty acid profiles of Prototheca moriformis cells containing an RNA hairpin construct to down-regulate the expression of FATA.

| Transformant | % C10:0 | % C12:0 | % C14:0 | % C16:0 | % C16:1 | % C18:0 | % C18:1 | % C18:2 |
|---|---|---|---|---|---|---|---|---|
| Untransformed | 0.01 | 0.03 | 1.23 | 25.68 | 0.96 | 2.83 | 60.54 | 7.52 |
| Transformant 1 | 0.01 | 0.03 | 0.71 | 15.10 | 1.05 | 1.67 | 72.08 | 8.27 |
| Transformant 2 | 0.01 | 0.03 | 0.81 | 15.66 | 1.16 | 1.56 | 70.03 | 9.61 |
| Transformant 3 | 0.01 | 0.03 | 1.09 | 22.67 | 1.05 | 2.12 | 63.18 | 8.66 |
| Transformant 4 | 0.01 | 0.04 | 1.14 | 23.31 | 1.01 | 2.23 | 62.83 | 8.26 |

The data presented in Table 68 show a clear impact of the expression of a FATA hairpin RNA construct on the C16 and C18:1 fatty acid profile of the host organism. The fatty acid profiles of strain A transformants comprising the FATA hairpin RNA construct demonstrated an increase in the percentage of C18:1 fatty acids with a concomitant diminution of C16 fatty acids. These data illustrate the successful expression and use of a polynucleotide FATA RNA hairpin construct in Prototheca moriformis to alter the fatty acid profile of engineered host microbes, and in particular in increasing the concentration of C18:1 fatty acids and decreasing C16 fatty acids in microbial cells.

Example 21

Engineering Chlorella sorokinian

Expression of recombinant genes in accordance with the present invention in Chlorella sorokinian can be accomplished by modifying the methods and vectors taught by Dawson et al. as discussed herein. Briefly, Dawson et al., Current Microbiology Vol. 35 (1997) pp. 356-362, reported the stable nuclear transformation of Chlorella sorokiniana with plasmid DNA. Using the transformation method of microprojectile bombardment, Dawson introduced the plasmid pSV72-NRg, encoding the full Chlorella vulgaris nitrate reductase gene (NR, GenBank Accession No. U39931), into mutant Chlorella sorokiniana (NR-mutants). The NR-mutants are incapable of growth without the use of nitrate as a source of nitrogen. Nitrate reductase catalyzes the conversion of nitrate to nitrite. Prior to transformation, Chlorella sorokiniana NR-mutants were unable to grow beyond the microcolony stage on culture medium comprising nitrate ($NO_3^-$) as the sole nitrogen source. The expression of the Chlorella vulgaris NR gene product in NR-mutant Chlorella sorokiniana was used as a selectable marker to rescue the nitrate metabolism deficiency. Upon transformation with the pSV72-NRg plasmid, NR-mutant Chlorella sorokiniana stably expressing the Chlorella vulgaris NR gene product were obtained that were able to grow beyond the microcolony stage on agar plates comprising nitrate as the sole carbon source. Evaluation of the DNA of the stable transformants was performed by Southern analysis and evaluation of the RNA of the stable transformants was performed by RNase protection. Selection and maintenance of the transformed Chlorella sorokiniana (NR mutant) was performed on agar plates (pH 7.4) comprising 0.2 g/L $MgSO_4$, 0.67 g/L $KH_2PO_4$, 3.5 g/L $K_2HPO_4$, 1.0 g/L $Na_3C_6H_5O_7 \cdot H_2O$ and 16.0 g/L agar, an appropriate nitrogen source (e.g., $NO_3^-$), micronutrients, and a carbon source. Dawson also reported the propagation of Chlorella sorokiniana and Chlorella sorokiniana NR mutants in liquid culture medium. Dawson reported that the plasmid pSV72-NRg and the promoter and 3' UTR/terminator of the Chlorella vulgaris nitrate reductase gene were suitable to enable heterologous gene expression in Chlorella sorokiniana NR-mutants. Dawson also reported that expression of the Chlorella vulgaris nitrate reductase gene product was suitable for use as a selectable marker in Chlorella sorokiniana NR-mutants.

In an embodiment of the present invention, vector pSV72-NRg, comprising nucleotide sequence encoding the *Chlorella vulgaris* nitrate reductase (CvNR) gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Chlorella sorokiniana* to reflect the codon bias inherent in nuclear genes of *Chlorella sorokiniana* in accordance with Tables 69A-D. For each lipid biosynthesis pathway protein of Table 70, the codon-optimized gene sequence can individually be operably linked to the CvNR promoter upstream of the protein-coding sequence and operably linked to the CvNR 3'UTR/terminator at the 3' region, or downstream, of the protein-coding sequence. The transformation construct may additionally comprise homology regions to the *Chlorella sorokiniana* genome for targeted genomic integration of the transformation vector. Homology regions may be selected to disrupt one or more genomic sites of endogenous lipid biosynthesis pathway genes. Stable transformation of *Chlorella sorokiniana* with the transformation vector is achieved through well-known transformation techniques including microprojectile bombardment or other known methods. Activity of the CvNR gene product can be used as a selectable marker to rescue the nitrogen assimiliation deficiency of *Chlorella sorokiniana* NR mutant strains and to select for *Chlorella sorokiniana* NR-mutants stably expressing the transformation vector. Growth media suitable for *Chlorella sorokiniana* lipid production include, but are not limited to 0.5 g/L $KH_2PO_4$, 0.5 g/L $K_2HPO_4$, 0.25 g/L $MgSO_4$-$7H_2O$, with supplemental micronutrients and the appropriate nitrogen and carbon sources (Patterson, *Lipids Vol.* 5:7 (1970), pp. 597-600). Evaluation of fatty acid profiles of *Chlorella sorokiniana* lipids can be assessed through standard lipid extraction and analytical methods described herein.

Examples 22-44

Introduction and Tables

Examples 22-44 below describe the engineering of various microorganisms in accordance with the present invention. To alter the fatty acid profile of a microorganism, microorganisms can be genetically modified wherein endogenous or exogenous lipid biosynthesis pathway enzymes are expressed, overexpressed, or attenuated. Steps to genetically engineer a microbe to alter its fatty acid profile as to the degree of fatty acid unsaturation and to decrease or increase fatty acid chain length comprise the design and construction of a transformation vector (e.g., a plasmid), transformation of the microbe with one or more vectors, selection of transformed microbes (transformants), growth of the transformed microbe, and analysis of the fatty acid profile of the lipids produced by the engineered microbe.

Transgenes that alter the fatty acid profiles of host organisms can be expressed in numerous eukaryotic microbes. Examples of expression of transgenes in eukaryotic microbes including *Chlamydomonas reinhardtii, Chlorella ellipsoidea, Chlorella saccarophila, Chlorella vulgaris, Chlorella kessleri, Chlorella sorokiniana, Haematococcus pluvialis, Gonium pectorale, Volvox carteri, Dunaliella tertiolecta, Dunaliella viridis, Dunaliella sauna, Closterium peracerosum-strigosum-littorale* complex, *Nannochloropsis* sp., *Thalassiosira pseudonana, Phaeodactylum tricornutum, Navicula saprophila, Cylindrotheca fusiformis, Cyclotella cryptica, Symbiodinium microadriacticum, Amphidinium* sp., *Chaetoceros* sp., *Mortierella alpina*, and *Yarrowia lipolytica* can be found in the scientific literature. These expression techniques can be combined with the teachings of the present invention to produce engineered microorganisms with altered fatty acid profiles.

Transgenes that alter the fatty acid profiles of host organisms can also be expressed in numerous prokaryotic microbes. Examples of expression of transgenes in oleaginous microbes including *Rhodococcus opacus* can be found in the literature. These expression techniques can be combined with the teachings of the present invention to produce engineered microorganisms with altered fatty acid profiles.

TABLES 69A-D

| Amino Acid | Codon | Chlorella sorokiniana | Chlorella vulgaris | Chlorella ellipsoidea | Chlorella kessleri | Dunaliella tertiolecta | Volvox carteri | Haematococcus pluvialis |
|---|---|---|---|---|---|---|---|---|
| Ala | GCG | 0.20 | 0.25 | 0.15 | 0.14 | 0.09 | 0.25 | 0.21 |
| Ala | GCA | 0.05 | 0.24 | 0.32 | 0.10 | 0.17 | 0.13 | 0.27 |
| Ala | GCT | 0.12 | 0.16 | 0.26 | 0.18 | 0.31 | 0.26 | 0.17 |
| Ala | GCC | 0.63 | 0.35 | 0.27 | 0.58 | 0.43 | 0.36 | 0.35 |
| Arg | AGG | 0.03 | 0.09 | 0.10 | 0.09 | 0.26 | 0.08 | 0.14 |
| Arg | AGA | 0.04 | 0.05 | 0.14 | 0.01 | 0.09 | 0.03 | 0.05 |
| Arg | CGG | 0.06 | 0.19 | 0.09 | 0.06 | 0.06 | 0.17 | 0.15 |
| Arg | CGA | 0.00 | 0.10 | 0.08 | 0.00 | 0.08 | 0.08 | 0.10 |
| Arg | CGT | 0.06 | 0.09 | 0.37 | 0.14 | 0.12 | 0.22 | 0.13 |
| Arg | CGC | 0.81 | 0.48 | 0.22 | 0.71 | 0.40 | 0.43 | 0.42 |
| Asn | AAT | 0.04 | 0.16 | 0.43 | 0.06 | 0.27 | 0.23 | 0.21 |
| Asn | AAC | 0.96 | 0.84 | 0.57 | 0.94 | 0.73 | 0.77 | 0.79 |
| Asp | GAT | 0.13 | 0.25 | 0.47 | 0.12 | 0.40 | 0.35 | 0.27 |
| Asp | GAC | 0.87 | 0.75 | 0.53 | 0.88 | 0.60 | 0.65 | 0.73 |
| Cys | TGT | 0.06 | 0.13 | 0.43 | 0.09 | 0.20 | 0.17 | 0.27 |
| Cys | TGC | 0.94 | 0.87 | 0.57 | 0.91 | 0.80 | 0.83 | 0.64 |
| End | TGA | 0.00 | 0.72 | 0.14 | 0.14 | 0.36 | 0.24 | 0.70 |
| End | TAG | 0.33 | 0.11 | 0.29 | 0.00 | 0.00 | 0.18 | 0.22 |
| End | TAA | 0.67 | 0.17 | 4.00 | 0.86 | 0.64 | 0.59 | 0.09 |
| Gln | CAG | 0.42 | 0.40 | 0.15 | 0.40 | 0.27 | 0.29 | 0.33 |
| Gln | CAA | 0.04 | 0.04 | 0.21 | 0.40 | 0.27 | 0.07 | 0.10 |
| Glu | GAG | 0.53 | 0.50 | 0.33 | 0.40 | 0.27 | 0.53 | 0.49 |
| Glu | GAA | 0.02 | 0.06 | 0.31 | 0.40 | 0.27 | 0.11 | 0.07 |
| Gly | GGG | 0.04 | 0.16 | 0.19 | 0.08 | 0.10 | 0.12 | 0.22 |
| Gly | GGA | 0.02 | 0.11 | 0.13 | 0.07 | 0.13 | 0.12 | 0.11 |

TABLES 69A-D-continued

Codon preference listing.

| Amino Acid | Codon | | | | | | |
|---|---|---|---|---|---|---|---|
| Gly | GGT | 0.03 | 0.12 | 0.39 | 0.24 | 0.25 | 0.23 | 0.15 |
| Gly | GGC | 0.91 | 0.61 | 0.29 | 0.96 | 0.51 | 0.53 | 0.52 |
| His | CAT | 0.14 | 0.16 | 0.30 | 0.08 | 0.25 | 0.35 | 0.27 |
| His | CAC | 0.86 | 0.84 | 0.70 | 0.93 | 0.75 | 0.65 | 0.73 |
| Ile | ATA | 0.00 | 0.04 | 0.07 | 0.01 | 0.04 | 0.08 | 0.09 |
| Ile | ATT | 0.15 | 0.30 | 0.63 | 0.29 | 0.31 | 0.35 | 0.29 |
| Ile | ATC | 0.85 | 0.66 | 0.65 | 0.69 | 0.65 | 0.57 | 0.62 |
| Leu | TTG | 0.03 | 0.07 | 0.03 | 0.05 | 0.14 | 0.14 | 0.16 |
| Leu | TTA | 0.00 | 0.01 | 0.32 | 0.00 | 0.02 | 0.03 | 0.02 |
| Leu | CTG | 0.72 | 0.61 | 0.34 | 0.61 | 0.60 | 0.45 | 0.53 |
| Leu | CTA | 0.01 | 0.03 | 0.03 | 0.04 | 0.04 | 0.07 | 0.07 |
| Leu | CTT | 0.04 | 0.08 | 0.16 | 0.06 | 0.06 | 0.14 | 0.09 |
| Leu | CTC | 0.20 | 0.20 | 0.12 | 0.24 | 0.14 | 0.17 | 0.13 |
| Lys | AAG | 0.98 | 0.94 | 0.54 | 0.98 | 0.90 | 0.90 | 0.84 |
| Lys | AAA | 0.02 | 0.06 | 0.46 | 0.02 | 0.10 | 0.10 | 0.16 |
| Met | ATG | 1.00 | 1.00 | 1.00 | 1.00 | 1.00 | 1.00 | 1.00 |
| Phe | TTT | 0.28 | 0.32 | 0.42 | 0.31 | 0.24 | 0.27 | 0.35 |
| Phe | TTC | 0.72 | 0.68 | 0.58 | 0.69 | 0.76 | 0.73 | 0.65 |
| Pro | CCG | 0.18 | 0.31 | 0.09 | 0.07 | 0.04 | 0.34 | 0.15 |
| Pro | CCA | 0.06 | 0.17 | 0.36 | 0.07 | 0.04 | 0.20 | 0.24 |
| Pro | CCT | 0.10 | 0.14 | 0.25 | 0.17 | 0.04 | 0.19 | 0.29 |
| Pro | CCC | 0.66 | 0.38 | 0.29 | 0.69 | 0.04 | 0.27 | 0.32 |
| Ser | AGT | 0.03 | 0.04 | 0.14 | 0.02 | 0.08 | 0.08 | 0.07 |
| Ser | AGC | 0.27 | 0.38 | 0.18 | 0.18 | 0.31 | 0.27 | 0.31 |
| Ser | TCG | 0.12 | 0.14 | 0.08 | 0.10 | 0.02 | 0.19 | 0.10 |
| Ser | TCA | 0.03 | 0.08 | 0.14 | 0.08 | 0.09 | 0.09 | 0.14 |
| Ser | TCT | 0.09 | 0.11 | 0.26 | 0.18 | 0.19 | 0.14 | 0.13 |
| Ser | TCC | 0.47 | 0.24 | 0.20 | 0.44 | 0.30 | 0.24 | 0.24 |
| Thr | ACG | 0.11 | 0.20 | 0.13 | 0.05 | 0.12 | 0.27 | 0.19 |
| Thr | ACA | 0.01 | 0.20 | 0.32 | 0.07 | 0.20 | 0.12 | 0.23 |
| Thr | ACT | 0.12 | 0.13 | 0.29 | 0.12 | 0.24 | 0.20 | 0.18 |
| Thr | ACC | 0.76 | 0.47 | 0.26 | 0.76 | 0.44 | 0.41 | 0.40 |
| Trp | TGG | 1.00 | 1.00 | 1.00 | 1.00 | 1.00 | 1.00 | 1.00 |
| Tyr | TAT | 0.07 | 0.15 | 0.43 | 0.27 | 0.28 | 0.24 | 0.19 |
| Tyr | TAC | 0.93 | 0.85 | 0.57 | 0.73 | 0.72 | 0.76 | 0.81 |
| Val | GTG | 0.71 | 0.54 | 0.37 | 0.60 | 0.54 | 0.46 | 0.62 |
| Val | GTA | 0.00 | 0.05 | 0.25 | 0.03 | 0.09 | 0.07 | 0.09 |
| Val | GTT | 0.11 | 0.14 | 0.24 | 0.09 | 0.14 | 0.17 | 0.09 |
| Val | GTC | 0.18 | 0.27 | 0.14 | 0.28 | 0.23 | 0.30 | 0.21 |

| Amino Acid | Codon | Closterium peracerosum-strigosum-littorale complex | Dunaliella viridis | Dunaliella salina | Gonium pectorale | Phaeodactylum tricornutum | Chaetoceros compressum |
|---|---|---|---|---|---|---|---|
| Ala | GCG | 0.48 | 0.13 | 0.15 | 0.43 | 0.15 | 0.08 |
| Ala | GCA | 0.10 | 0.27 | 0.20 | 0.09 | 0.10 | 0.37 |
| Ala | GCT | 0.15 | 0.25 | 0.27 | 0.08 | 0.23 | 0.36 |
| Ala | GCC | 0.26 | 0.35 | 0.39 | 0.41 | 0.52 | 0.18 |
| Arg | AGG | 0.04 | 0.25 | 0.22 | 0.13 | 0.02 | 0.14 |
| Arg | AGA | 0.00 | 0.06 | 0.05 | 0.00 | 0.04 | 0.29 |
| Arg | CGG | 0.18 | 0.08 | 0.12 | 0.40 | 0.10 | 0.00 |
| Arg | CGA | 0.00 | 0.06 | 0.06 | 0.05 | 0.12 | 0.19 |
| Arg | CGT | 0.13 | 0.15 | 0.13 | 0.08 | 0.41 | 0.38 |
| Arg | CGC | 0.64 | 0.39 | 0.43 | 0.35 | 0.31 | 0.00 |
| Asn | AAT | 0.04 | 0.17 | 0.23 | 0.07 | 0.30 | 0.58 |
| Asn | AAC | 0.96 | 0.83 | 0.77 | 0.93 | 0.65 | 0.42 |
| Asp | GAT | 0.30 | 0.38 | 0.40 | 0.11 | 0.41 | 0.53 |
| Asp | GAC | 0.70 | 0.62 | 0.60 | 0.89 | 0.59 | 0.47 |
| Cys | TGT | 0.06 | 0.24 | 0.17 | 0.20 | 0.39 | 0.44 |
| Cys | TGC | 0.94 | 0.76 | 0.83 | 0.90 | 0.61 | 0.56 |
| End | TGA | 0.75 | 0.31 | 0.37 | 0.50 | 0.06 | 0.50 |
| End | TAG | 0.00 | 0.15 | 0.14 | 0.00 | 0.13 | 0.00 |
| End | TAA | 0.25 | 0.54 | 0.49 | 0.50 | 0.81 | 0.50 |
| Gln | CAG | 0.53 | 0.36 | 0.32 | 0.31 | 0.23 | 0.16 |
| Gln | CAA | 0.09 | 0.12 | 0.08 | 0.07 | 0.14 | 0.19 |
| Glu | GAG | 0.31 | 0.44 | 0.51 | 0.56 | 0.21 | 0.28 |
| Glu | GAA | 0.06 | 0.09 | 0.09 | 0.07 | 0.42 | 0.37 |
| Gly | GGG | 0.31 | 0.14 | 0.10 | 0.18 | 0.08 | 0.12 |
| Gly | GGA | 0.06 | 0.11 | 0.12 | 0.09 | 0.34 | 0.33 |
| Gly | GGT | 0.09 | 0.22 | 0.22 | 0.07 | 0.30 | 0.39 |
| Gly | GGC | 0.53 | 0.54 | 0.56 | 0.65 | 0.28 | 0.16 |
| His | CAT | 0.33 | 0.25 | 0.25 | 0.43 | 0.28 | 0.84 |
| His | CAC | 0.67 | 0.75 | 0.75 | 0.57 | 0.72 | 0.16 |
| Ile | ATA | 0.03 | 0.03 | 0.03 | 0.07 | 0.03 | 0.12 |
| Ile | ATT | 0.23 | 0.25 | 0.31 | 0.33 | 0.51 | 0.65 |
| Ile | ATC | 0.74 | 0.72 | 0.66 | 0.59 | 0.46 | 0.23 |
| Leu | TTG | 0.04 | 0.11 | 0.12 | 0.04 | 0.26 | 0.11 |

TABLES 69A-D-continued

Codon preference listing.

| Leu | TTA | 0.00 | 0.01 | 0.01 | 0.00 | 0.02 | 0.14 |
|---|---|---|---|---|---|---|---|
| Leu | CTG | 0.31 | 0.60 | 0.61 | 0.64 | 0.15 | 0.05 |
| Leu | CTA | 0.01 | 0.05 | 0.04 | 0.01 | 0.05 | 0.08 |
| Leu | CTT | 0.04 | 0.07 | 0.08 | 0.05 | 0.18 | 0.51 |
| Leu | CTC | 0.60 | 0.16 | 0.14 | 0.26 | 0.34 | 0.11 |
| Lys | AAG | 0.86 | 0.87 | 0.89 | 0.93 | 0.75 | 0.52 |
| Lys | AAA | 0.14 | 0.13 | 0.11 | 0.07 | 0.25 | 0.48 |
| Met | ATG | 1.00 | 1.00 | 1.00 | 1.00 | 1.00 | 1.00 |
| Phe | TTT | 0.09 | 0.25 | 0.29 | 0.10 | 0.44 | 0.65 |
| Phe | TTC | 0.91 | 0.75 | 0.71 | 0.90 | 0.56 | 0.35 |
| Pro | CCG | 0.28 | 0.10 | 0.08 | 0.53 | 0.29 | 0.05 |
| Pro | CCA | 0.15 | 0.10 | 0.17 | 0.09 | 0.12 | 0.45 |
| Pro | CCT | 0.12 | 0.10 | 0.30 | 0.04 | 0.20 | 0.33 |
| Pro | CCC | 0.44 | 0.10 | 0.45 | 0.34 | 0.40 | 0.17 |
| Ser | AGT | 0.04 | 0.09 | 0.06 | 0.02 | 0.12 | 0.14 |
| Ser | AGC | 0.05 | 0.31 | 0.32 | 0.20 | 0.12 | 0.07 |
| Ser | TCG | 0.22 | 0.04 | 0.06 | 0.42 | 0.19 | 0.08 |
| Ser | TCA | 0.16 | 0.08 | 0.10 | 0.09 | 0.06 | 0.31 |
| Ser | TCT | 0.05 | 0.17 | 0.15 | 0.07 | 0.15 | 0.23 |
| Ser | TCC | 0.47 | 0.31 | 0.30 | 0.20 | 0.35 | 0.18 |
| Thr | ACG | 0.30 | 0.16 | 0.13 | 0.42 | 0.23 | 0.10 |
| Thr | ACA | 0.06 | 0.21 | 0.18 | 0.03 | 0.13 | 0.38 |
| Thr | ACT | 0.22 | 0.18 | 0.23 | 0.08 | 0.19 | 0.27 |
| Thr | ACC | 0.42 | 0.46 | 0.46 | 0.47 | 0.45 | 0.25 |
| Trp | TGG | 1.00 | 1.00 | 1.00 | 1.00 | 1.00 | 1.00 |
| Tyr | TAT | 0.07 | 0.16 | 0.21 | 0.12 | 0.18 | 0.67 |
| Tyr | TAC | 0.93 | 0.84 | 0.79 | 0.88 | 0.82 | 0.33 |
| Val | GTG | 0.50 | 0.64 | 0.62 | 0.57 | 0.22 | 0.30 |
| Val | GTA | 0.02 | 0.03 | 0.05 | 0.04 | 0.09 | 0.27 |
| Val | GTT | 0.06 | 0.11 | 0.11 | 0.04 | 0.22 | 0.10 |
| Val | GTC | 0.42 | 0.22 | 0.23 | 0.35 | 0.47 | 0.33 |

| Amino Acid | Codon | Cylindrotheca fusiformis | Amphidinium carterae | Symbiodinium microadriacticum | Nannochloropsis sp | Cyclotella cryptica | Navicula pelliculosa | Thalassiosira pseudonana | C. reinhardtii |
|---|---|---|---|---|---|---|---|---|---|
| Ala | GCG | 0.07 | 0.17 | 0.22 | 0.24 | 0.11 | 0.00 | 0.11 | 0.35 |
| Ala | GCA | 0.14 | 0.33 | 0.26 | 0.10 | 0.16 | 0.13 | 0.25 | 0.08 |
| Ala | GCT | 0.35 | 0.29 | 0.20 | 0.17 | 0.45 | 0.44 | 0.33 | 0.13 |
| Ala | GCC | 0.43 | 0.20 | 0.32 | 0.48 | 0.27 | 0.44 | 0.30 | 0.43 |
| Arg | AGG | 0.09 | 0.15 | 0.27 | 0.00 | 0.09 | 0.05 | 0.18 | 0.05 |
| Arg | AGA | 0.14 | 0.03 | 0.27 | 0.00 | 0.05 | 0.10 | 0.17 | 0.01 |
| Arg | CGG | 0.06 | 0.08 | 0.09 | 0.00 | 0.04 | 0.05 | 0.06 | 0.20 |
| Arg | CGA | 0.16 | 0.18 | 0.09 | 0.29 | 0.08 | 0.35 | 0.11 | 0.04 |
| Arg | CGT | 0.34 | 0.18 | 0.09 | 0.14 | 0.47 | 0.20 | 0.34 | 0.09 |
| Arg | CGC | 0.22 | 0.40 | 0.18 | 0.57 | 0.28 | 0.25 | 0.15 | 0.62 |
| Asn | AAT | 0.42 | 0.37 | 0.21 | 0.00 | 0.25 | 0.47 | 0.43 | 0.09 |
| Asn | AAC | 0.58 | 0.63 | 0.79 | 1.00 | 0.75 | 0.53 | 0.57 | 0.91 |
| Asp | GAT | 0.54 | 0.54 | 0.50 | 0.20 | 0.52 | 0.20 | 0.56 | 0.14 |
| Asp | GAC | 0.46 | 0.46 | 0.50 | 0.80 | 0.48 | 0.80 | 0.44 | 0.86 |
| Cys | TGT | 0.44 | 0.75 | 0.50 | 0.00 | 0.29 | 0.10 | 0.54 | 0.10 |
| Cys | TGC | 0.56 | 0.25 | 0.50 | 1.00 | 0.71 | 0.90 | 0.46 | 0.90 |
| End | TGA | 0.13 | 0.50 | 1.00 | 0.00 | 0.10 | 0.00 | 0.31 | 0.27 |
| End | TAG | 0.10 | 0.00 | 0.00 | 0.00 | 0.00 | 0.00 | 0.38 | 0.22 |
| End | TAA | 0.77 | 0.50 | 0.00 | 1.00 | 0.90 | 1.00 | 0.31 | 0.52 |
| Gln | CAG | 0.12 | 0.33 | 0.28 | 0.41 | 0.19 | 0.21 | 0.16 | 0.38 |
| Gln | CAA | 0.25 | 0.15 | 0.17 | 0.00 | 0.17 | 0.28 | 0.19 | 0.04 |
| Glu | GAG | 0.23 | 0.41 | 0.50 | 0.59 | 0.38 | 0.17 | 0.40 | 0.55 |
| Glu | GAA | 0.39 | 0.10 | 0.06 | 0.00 | 0.26 | 0.34 | 0.26 | 0.03 |
| Gly | GGG | 0.06 | 0.19 | 0.32 | 0.10 | 0.10 | 0.03 | 0.12 | 0.11 |
| Gly | GGA | 0.47 | 0.10 | 0.12 | 0.05 | 0.45 | 0.28 | 0.51 | 0.06 |
| Gly | GGT | 0.35 | 0.34 | 0.16 | 0.25 | 0.22 | 0.13 | 0.23 | 0.11 |
| Gly | GGC | 0.12 | 0.37 | 0.40 | 0.60 | 0.24 | 0.56 | 0.14 | 0.72 |
| His | CAT | 0.39 | 0.12 | 0.40 | 0.00 | 0.42 | 1.00 | 0.50 | 0.11 |
| His | CAC | 0.61 | 0.88 | 0.60 | 1.00 | 0.58 | 0.00 | 0.50 | 0.89 |
| Ile | ATA | 0.06 | 0.05 | 0.00 | 0.00 | 0.04 | 0.00 | 0.08 | 0.03 |
| Ile | ATT | 0.42 | 0.53 | 0.38 | 0.14 | 0.53 | 0.73 | 0.38 | 0.22 |
| Ile | ATC | 0.52 | 0.42 | 0.63 | 0.86 | 0.42 | 0.27 | 0.54 | 0.75 |
| Leu | TTG | 0.26 | 0.35 | 0.39 | 0.22 | 0.20 | 0.16 | 0.29 | 0.04 |
| Leu | TTA | 0.09 | 0.01 | 0.00 | 0.00 | 0.03 | 0.00 | 0.05 | 0.01 |
| Leu | CTG | 0.09 | 0.22 | 0.39 | 0.09 | 0.06 | 0.12 | 0.08 | 0.73 |
| Leu | CTA | 0.05 | 0.00 | 0.04 | 0.00 | 0.03 | 0.04 | 0.06 | 0.03 |
| Leu | CTT | 0.37 | 0.31 | 0.13 | 0.04 | 0.39 | 0.36 | 0.20 | 0.05 |
| Leu | CTC | 0.13 | 0.12 | 0.04 | 0.65 | 0.29 | 0.32 | 0.32 | 0.15 |
| Lys | AAG | 0.60 | 0.93 | 0.85 | 1.00 | 0.70 | 0.83 | 0.76 | 0.95 |
| Lys | AAA | 0.40 | 0.07 | 0.15 | 0.00 | 0.30 | 0.17 | 0.24 | 0.05 |
| Met | ATG | 1.00 | 1.00 | 1.00 | 1.00 | 1.00 | 1.00 | 1.00 | 1.00 |
| Phe | TTT | 0.37 | 0.21 | 0.25 | 0.20 | 0.31 | 0.78 | 0.38 | 0.16 |

TABLES 69A-D-continued

Codon preference listing.

| Phe | TTC | 0.63 | 0.79 | 0.75 | 0.80 | 0.69 | 0.22 | 0.62 | 0.84 |
|---|---|---|---|---|---|---|---|---|---|
| Pro | CCG | 0.11 | 0.14 | 0.18 | 0.08 | 0.10 | 0.21 | 0.16 | 0.33 |
| Pro | CCA | 0.33 | 0.42 | 0.09 | 0.08 | 0.16 | 0.29 | 0.31 | 0.08 |
| Pro | CCT | 0.32 | 0.22 | 0.41 | 0.25 | 0.35 | 0.21 | 0.31 | 0.13 |
| Pro | CCC | 0.24 | 0.22 | 0.32 | 0.58 | 0.39 | 0.29 | 0.23 | 0.47 |
| Ser | AGT | 0.12 | 0.13 | 0.09 | 0.00 | 0.09 | 0.13 | 0.18 | 0.04 |
| Ser | AGC | 0.09 | 0.24 | 0.14 | 0.13 | 0.08 | 0.28 | 0.11 | 0.35 |
| Ser | TCG | 0.13 | 0.03 | 0.05 | 0.00 | 0.15 | 0.25 | 0.17 | 0.25 |
| Ser | TCA | 0.12 | 0.25 | 0.05 | 0.00 | 0.12 | 0.08 | 0.12 | 0.05 |
| Ser | TCT | 0.30 | 0.16 | 0.23 | 0.13 | 0.39 | 0.25 | 0.23 | 0.07 |
| Ser | TCC | 0.24 | 0.19 | 0.45 | 0.75 | 0.18 | 0.03 | 0.19 | 0.25 |
| Thr | ACG | 0.09 | 0.14 | 0.10 | 0.28 | 0.10 | 0.18 | 0.21 | 0.30 |
| Thr | ACA | 0.15 | 0.28 | 0.10 | 0.00 | 0.15 | 0.09 | 0.19 | 0.08 |
| Thr | ACT | 0.39 | 0.12 | 0.10 | 0.17 | 0.33 | 0.41 | 0.28 | 0.10 |
| Thr | ACC | 0.37 | 0.47 | 0.70 | 0.56 | 0.43 | 0.32 | 0.32 | 0.52 |
| Trp | TGG | 1.00 | 1.00 | 1.00 | 1.00 | 1.00 | 1.00 | 1.00 | 1.00 |
| Tyr | TAT | 0.38 | 0.32 | 0.20 | 0.00 | 0.38 | 0.20 | 0.39 | 0.10 |
| Tyr | TAC | 0.62 | 0.68 | 0.80 | 1.00 | 0.62 | 0.80 | 0.61 | 0.90 |
| Val | GTG | 0.11 | 0.65 | 0.67 | 0.31 | 0.16 | 0.18 | 0.29 | 0.67 |
| Val | GTA | 0.06 | 0.05 | 0.00 | 0.00 | 0.09 | 0.09 | 0.16 | 0.03 |
| Val | GTT | 0.38 | 0.08 | 0.11 | 0.15 | 0.42 | 0.09 | 0.28 | 0.07 |
| Val | GTC | 0.46 | 0.21 | 0.22 | 0.54 | 0.33 | 0.64 | 0.27 | 0.22 |

| Amino Acid | Codon | Yarrowia lipolytica | Mortierella alpina | Rhodococcus opacus |
|---|---|---|---|---|
| Ala | GCG | 0.08 | 0.14 | 0.35 |
| Ala | GCA | 0.11 | 0.12 | 0.14 |
| Ala | GCT | 0.35 | 0.29 | 0.09 |
| Ala | GCC | 0.46 | 0.45 | 0.43 |
| Arg | AGG | 0.05 | 0.05 | 0.05 |
| Arg | AGA | 0.13 | 0.06 | 0.02 |
| Arg | CGG | 0.12 | 0.06 | 0.26 |
| Arg | CGA | 0.52 | 0.09 | 0.12 |
| Arg | CGT | 0.11 | 0.32 | 0.11 |
| Arg | CGC | 0.07 | 0.42 | 0.44 |
| Asn | AAT | 0.17 | 0.15 | 0.21 |
| Asn | AAC | 0.83 | 0.85 | 0.79 |
| Asp | GAT | 0.35 | 0.42 | 0.24 |
| Asp | GAC | 0.65 | 0.58 | 0.76 |
| Cys | TGT | 0.46 | 0.13 | 0.26 |
| Cys | TGC | 0.54 | 0.87 | 0.74 |
| End | TGA | 0.16 | 0.05 | 0.72 |
| End | TAG | 0.38 | 0.25 | 0.17 |
| End | TAA | 0.46 | 0.70 | 0.11 |
| Gln | CAG | 0.33 | 0.36 | 0.28 |
| Gln | CAA | 0.08 | 0.06 | 0.06 |
| Glu | GAG | 0.44 | 0.49 | 0.45 |
| Glu | GAA | 0.14 | 0.09 | 0.22 |
| Gly | GGG | 0.05 | 0.03 | 0.18 |
| Gly | GGA | 0.28 | 0.29 | 0.15 |
| Gly | GGT | 0.32 | 0.32 | 0.20 |
| Gly | GGC | 0.34 | 0.36 | 0.48 |
| His | CAT | 0.34 | 0.27 | 0.20 |
| His | CAC | 0.66 | 0.73 | 0.80 |
| Ile | ATA | 0.03 | 0.01 | 0.05 |
| Ile | ATT | 0.44 | 0.33 | 0.14 |
| Ile | ATC | 0.53 | 0.66 | 0.81 |
| Leu | TTG | 0.09 | 0.27 | 0.09 |
| Leu | TTA | 0.02 | 0.00 | 0.01 |
| Leu | CTG | 0.37 | 0.26 | 0.41 |
| Leu | CTA | 0.05 | 0.02 | 0.03 |
| Leu | CTT | 0.18 | 0.12 | 0.06 |
| Leu | CTC | 0.29 | 0.32 | 0.40 |
| Lys | AAG | 0.84 | 0.91 | 0.80 |
| Lys | AAA | 0.16 | 0.09 | 0.20 |
| Met | ATG | 1.00 | 1.00 | 1.00 |
| Phe | TTT | 0.38 | 0.39 | 0.09 |
| Phe | TTC | 0.62 | 0.61 | 0.91 |
| Pro | CCG | 0.10 | 0.07 | 0.52 |
| Pro | CCA | 0.10 | 0.08 | 0.09 |
| Pro | CCT | 0.32 | 0.36 | 0.07 |
| Pro | CCC | 0.47 | 0.49 | 0.32 |
| Ser | AGT | 0.07 | 0.05 | 0.08 |
| Ser | AGC | 0.11 | 0.14 | 0.23 |
| Ser | TCG | 0.16 | 0.32 | 0.33 |
| Ser | TCA | 0.08 | 0.08 | 0.07 |
| Ser | TCT | 0.28 | 0.12 | 0.05 |

TABLES 69A-D-continued

Codon preference listing.

| Ser | TCC | 0.30 | 0.29 | 0.24 |
|---|---|---|---|---|
| Thr | ACG | 0.11 | 0.17 | 0.28 |
| Thr | ACA | 0.14 | 0.10 | 0.11 |
| Thr | ACT | 0.26 | 0.23 | 0.07 |
| Thr | ACC | 0.49 | 0.49 | 0.53 |
| Trp | TGG | 1.00 | 1.00 | 1.00 |
| Tyr | TAT | 0.18 | 0.20 | 0.18 |
| Tyr | TAC | 0.82 | 0.80 | 0.82 |
| Val | GTG | 0.33 | 0.22 | 0.37 |
| Val | GTA | 0.05 | 0.02 | 0.05 |
| Val | GTT | 0.26 | 0.27 | 0.10 |
| Val | GTC | 0.36 | 0.49 | 0.49 |

TABLE 70

Lipid biosynthesis pathway proteins.

3-Ketoacyl ACP synthase

*Cuphea hookeriana* 3-ketoacyl-ACP synthase (GenBank Acc. No. AAC68861.1), *Cuphea wrightii* beta-ketoacyl-ACP synthase II (GenBank Acc. No. AAB37271.1), *Cuphea lanceolata* beta-ketoacyl-ACP synthase IV (GenBank Acc. No. CAC59946.1), *Cuphea wrightii* beta-ketoacyl-ACP synthase II (GenBank Acc. No. AAB37270.1), *Ricinus communis* ketoacyl-ACP synthase (GenBank Acc. No. XP_002516228 ), *Gossypium hirsutum* ketoacyl-ACP synthase (GenBank Acc. No. ADK23940.1), *Glycine max* plastid 3-keto-acyl-ACP synthase II-A (GenBank Acc No. AAW88763.1), *Elaeis guineensis* beta-ketoacyl-ACP synthase II (GenBank Acc. No. AAF26738.2), *Helianthus annuus* plastid 3-keto-acyl-ACP synthase I (GenkBank Acc. No. ABM53471.1), *Glycine max* 3-keto-acyl-ACP synthase I (GenkBank Acc. No. NP_001238610.1), *Helianthus annuus* plastid 3-keto-acyl-ACP synthase II (GenBank Acc ABI18155.1), *Brassica napus* beta-ketoacyl-ACP synthetase 2 (GenBank Acc. No. AAF61739.1), *Perilla frutescens* beta-ketoacyl-ACP synthase II (GenBank Acc. No. AAC04692.1), *Helianthus annus* beta-ketoacyl-ACP synthase II (GenBank Accession No. ABI18155), *Ricinus communis* beta-ketoacyl-ACP synthase II (GenBank Accession No. AAA33872), *Haematococcus pluvialis* beta-ketoacyl acyl carrier protein synthase (GenBank Accession No. HM560033.1), *Jatropha curcas* beta ketoacyl-ACP synthase I (GenBank Accession No. ABJ90468.1), *Populus trichocarpa* beta-ketoacyl-ACP synthase I (GenBank Accession No. XP_002303661.1), *Coriandrum sativum* beta-ketoacyl-ACP synthetase I (GenBank Accession No. AAK58535.1), *Arabidopsis thaliana* 3-oxoacyl-[acyl-carrier-protein] synthase I (GenBank Accession No. NP_001190479.1), *Vitis vinifera* 3-oxoacyl-[acyl-carrier-protein] synthase I (GenBank Accession No. XP_002272874.2)

Fatty acyl-ACP Thioesterases

*Umbellularia californica* fatty acyl-ACP thioesterase (GenBank Acc. No. AAC49001), *Cinnamomum camphora* fatty acyl-ACP thioesterase (GenBank Acc. No. Q39473), *Umbellularia californica* fatty acyl-ACP thioesterase (GenBank Acc. No. Q41635), *Myristica fragrans* fatty acyl-ACP thioesterase (GenBank Acc. No. AAB71729), *Myristica fragrans* fatty acyl-ACP thioesterase (GenBank Acc. No. AAB71730), *Elaeis guineensis* fatty acyl-ACP thioesterase (GenBank Acc. No. ABD83939), *Elaeis guineensis* fatty acyl-ACP thioesterase (GenBank Acc. No. AAD42220), *Populus tomentosa* fatty acyl-ACP thioesterase (GenBank Acc. No. ABC47311), *Arabidopsis thaliana* fatty acyl-ACP thioesterase (GenBank Acc. No. NP_172327), *Arabidopsis thaliana* fatty acyl-ACP thioesterase (GenBank Acc. No. CAA85387), *Arabidopsis thaliana* fatty acyl-ACP thioesterase (GenBank Acc. No. CAA85388), *Gossypium hirsutum* fatty acyl-ACP thioesterase (GenBank Acc. No. Q9SQI3), *Cuphea lanceolata* fatty acyl-ACP thioesterase (GenBank Acc. No. CAA54060), *Cuphea hookeriana* fatty acyl-ACP thioesterase (GenBank Acc. No. AAC72882), *Cuphea calophylla subsp. mesostemon* fatty acyl-ACP thioesterase (GenBank Acc. No. ABB71581), *Cuphea lanceolata* fatty acyl-ACP thioesterase (GenBank Acc. No. CAC19933), *Elaeis guineensis* fatty acyl-ACP thioesterase (GenBank Acc. No. AAL15645), *Cuphea hookeriana* fatty acyl-ACP thioesterase (GenBank Acc. No. Q39513), *Gossypium hirsutum* fatty acyl-ACP thioesterase (GenBank Acc. No. AAD01982), *Vitis vinifera* fatty acyl-ACP thioesterase (GenBank Acc. No. CAN81819), *Garcinia mangostana* fatty acyl-ACP thioesterase (GenBank Acc. No. AAB51525), *Brassica juncea* fatty acyl-ACP thioesterase (GenBank Acc. No. ABI18986), *Madhuca longifolia* fatty acyl-ACP thioesterase (GenBank Acc. No. AAX51637), *Brassica napus* fatty acyl-ACP thioesterase (GenBank Acc. No. ABH11710), *Brassica napus* fatty acyl-ACP thioesterase (GenBank Acc. No. CAA52070.1), *Oryza sativa* (indica cultivar-group) fatty acyl-ACP thioesterase (GenBank Acc. No. EAY86877), *Oryza sativa* (japonica cultivar-group) fatty acyl-ACP thioesterase (GenBank Acc. No. NP_001068400), *Oryza sativa* (indica cultivar-group) fatty acyl-ACP thioesterase (GenBank Acc. No. EAY99617), *Cuphea hookeriana* fatty acyl-ACP thioesterase (GenBank Acc. No. AAC49269), *Ulmus Americana* fatty acyl-ACP thioesterase (GenBank Acc. No. AAB71731), *Cuphea lanceolata* fatty acyl-ACP thioesterase (GenBank Acc. No. CAB60830), *Cuphea palustris* fatty acyl-ACP thioesterase (GenBank Acc. No. AAC49180), *Iris germanica* fatty acyl-ACP thioesterase (GenBank Acc. No. AAG43858, *Iris germanica* fatty acyl-ACP thioesterase (GenBank Acc. No. AAG43858.1), *Cuphea palustris* fatty acyl-ACP thioesterase (GenBank Acc. No. AAC49179), *Myristica fragrans* fatty acyl-ACP thioesterase (GenBank

TABLE 70-continued

Lipid biosynthesis pathway proteins.

Acc. No. AAB71729), *Myristica fragrans* fatty acyl-ACP thioesterase (GenBank Acc. No. AAB717291.1), *Cuphea hookeriana* fatty acyl-ACP thioesterase GenBank Acc. No. U39834), *Umbelluaria californica* fatty acyl-ACP thioesterase (GenBank Acc. No. M94159), *Cinnamomum camphora* fatty acyl-ACP thioesterase (GenBank Acc. No. U31813), *Ricinus communis* fatty acyl-ACP thioesterase (GenBank Acc. No. ABS30422.1), *Helianthus annuus* acyl-ACP thioesterase (GenBank Accession No. AAL79361.1), *Jatropha curcas* acyl-ACP thioesterase (GenBank Accession No. ABX82799.3), *Zea mays* oleoyl-acyl carrier protein thioesterase, (GenBank Accession No. ACG40089.1), *Haematococcus pluvialis* fatty acyl-ACP thioesterase (GenBank Accession No. HM560034.1)

Desaturase Enzymes

*Linum usitatissimum* fatty acid desaturase 3C, (GenBank Acc. No. ADV92272.1), *Ricinus communis* omega-3 fatty acid desaturase, endoplasmic reticulum, putative, (GenBank Acc. No. EEF36775.1), *Vernicia fordii* omega-3 fatty acid desaturase, (GenBank Acc. No. AAF12821), *Glycine max* chloroplast omega 3 fatty acid desaturase isoform 2, (GenBank Acc. No. ACF19424.1), *Prototheca moriformis* FAD-D omega 3 desaturase (SEQ ID NO: 221), *Prototheca moriformis* linoleate desaturase (SEQ ID NO: 220), *Carthamus tinctorius* delta 12 desaturase, (GenBank Accession No. ADM48790.1), *Gossypium hirsutum* omega-6 desaturase, (GenBank Accession No. CAA71199.1), *Glycine max* microsomal desaturase (GenBank Accession No. BAD89862.1), *Zea mays* fatty acid desaturase (GenBank Accession No. ABF50053.1), *Brassica napa* linoleic acid desaturase (GenBank Accession No. AAA32994.1), *Camelina sativa* omega-3 desaturase (SEQ ID NO: 214), *Prototheca moriformis* delta 12 desaturase allele 2 (SEQ ID NO: 212), *Camelina sativa* omega-3 FAD7-1 (SEQ ID NO: 215), *Helianthus annuus* stearoyl-ACP desaturase, (GenBank Accession No. AAB65145.1), *Ricinus communis* stearoyl-ACP desaturase, (GenBank Accession No. AACG59946.1), *Brassica juncea* plastidic delta-9-stearoyl-ACP desaturase (GenBank Accession No. AAD40245.1), *Glycine max* stearoyl-ACP desaturase (GenBank Accession No. ACJ39209.1), *Olea europaea* stearoyl-ACP desaturase (GenBank Accession No. AAB67840.1), *Vernicia fordii* stearoyl-acyl-carrier protein desaturase, (GenBank Accession No. ADC32803.1), *Descurainia sophia* delta-12 fatty acid desaturase (GenBank Accession No. ABS86964.2), *Euphorbia lagascae* delta12-oleic acid desaturase (GenBank Acc. No. AAS57577.1), *Chlorella vulgaris* delta 12 fatty acid desaturease (GenBank Accession No. ACF98528), *Chlorella vulgaris* omega-3 fatty acid desaturease (GenBank Accession No. BAB78717), *Haematococcus pluvialis* omega-3 fatty acid desaturase (GenBank Accession No. HM560035.1), *Haematococcus pluvialis* stearoyl-ACP-desaturase GenBank Accession No. EF586860.1, *Haematococcus pluvialis* stearoyl-ACP-desaturase GenBank Accession No. EF523479.1

Oleate 12-hydroxylase Enzymes

*Ricinus communis* oleate 12-hydroxylase (GenBank Acc. No. AAC49010.1), *Physaria lindheimeri* oleate 12-hydroxylase (GenBank Acc. No. ABQ01458.1), *Physaria lindheimeri* mutant bifunctional oleate 12-hydroxylase: desaturase (GenBank Acc. No. ACF17571.1), *Physaria lindheimeri* bifunctional oleate 12-hydroxylase: desaturase (GenBank Accession No. ACQ42234.1), *Physaria lindheimeri* bifunctional oleate 12-hydroxylase: desaturase (GenBank Acc. No. AAC32755.1), *Arabidopsis lyrata* subsp. *Lyrata* (GenBank Acc. No. XP_002884883.1)

Example 22

Engineering *Chlorella vulgaris*

Expression of recombinant genes in accordance with the present invention in *Chlorella vulgaris* can be accomplished by modifying the methods and vectors taught by Chow and Tung et al. as discussed herein. Briefly, Chow and Tung et al., *Plant Cell Reports*, Volume 18 (1999), pp. 778-780, reported the stable nuclear transformation of *Chlorella vulgaris* with plasmid DNA. Using the transformation method of electroporation, Chow and Tung introduced the plasmid pIG121-Hm (GenBank Accession No. AB489142) into *Chlorella vulgaris*. The nucleotide sequence of pIG121-Hm comprised sequence encoding a beta-glucuronidase (GUS) reporter gene product operably-linked to a CaMV 35S promoter upstream of the GUS protein-coding sequence and further operably linked to the 3' UTR/terminator of the nopaline synthase (nos) gene downstream of the GUS protein-coding sequence. The sequence of plasmid pIG121-Hm further comprised a hygromycin B antibiotic resistance cassette. This hygromycin B antibiotic resistance cassette comprised a CaMV 35S promoter operably linked to sequence encoding the hygromycin phosphotransferase (hpt, GenBank Accession No. BAH24259) gene product. Prior to transformation, *Chlorella vulgaris* was unable to be propagated in culture medium comprising 50 ug/ml hygromycin B. Upon transformation with the pIG121-Hm plasmid, transformants of *Chlorella vulgaris* were obtained that were propagated in culture medium comprising 50 ug/ml hyrgromycin B. The expression of the hpt gene product in *Chlorella vulgaris* enabled propagation of transformed *Chlorella vulgaris* in the presence of 50 ug/mL hyrgromycin B, thereby establishing the utility of the a hygromycin B resistance cassette as a selectable marker for use in *Chlorella vulgaris*. Detectable activity of the GUS reporter gene indicated that CaMV 35S promoter and nos 3'UTR are suitable for enabling heterologous gene expression in *Chlorella vulgaris*. Evaluation of the genomic DNA of the stable transformants was performed by Southern analysis. Selection and maintenance of transformed *Chlorella vulgaris* was performed on agar plates comprising YA medium (agar and 4 g/L yeast extract). The propagation of *Chlorella vulgaris* in liquid culture medium was conducted as discussed by Chow and Tung. Propagation of *Chlorella vulgaris* in media other than YA medium has been described (for examples, see Chader et al., *Revue des Energies Renouvelabes*, Volume 14 (2011), pp. 21-26 and Illman et al., *Enzyme and Microbial Technology*, Vol. 27 (2000), pp. 631-635). Chow and Tung reported that the plasmid pIG121-Hm, the CaMV 35S promoter, and the *Agrobacterium tumefaciens* nopaline synthase gene 3'UTR/terminator are suitable to enable heterologous gene expression in *Chlorella vulgaris*. In addition, Chow and Tung reported the hyromycin B resistance cassette was suitable for use as a selectable marker in *Chlorella vulgaris*. Additional plasmids, promoters, 3'UTR/terminators, and selectable markers suitable for enabling heterologous gene expression in *Chlorella vulgaris* have been discussed in Chader et al., *Revue des Energies Renouvelabes*, Volume 14 (2011), pp. 21-26.

In an embodiment of the present invention, pIG121-Hm, comprising the nucleotide sequence encoding the hygromycin B gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Chlorella vulgaris* to reflect the codon bias inherent in nuclear genes of *Chlorella vulgaris* in accordance with Tables 69A-D. For each lipid biosynthesis pathway protein of Table 70, the codon-optimized gene sequence can individually be operably linked to the CaMV 35S promoter upstream of the protein-coding sequence and operably linked to the *Agrobacterium tumefaciens* nopaline synthase gene 3' UTR/terminator at the 3' region, or downstream, of the protein-coding sequence. The transformation construct may additionally comprise homology regions to the *Chlorella vulgaris* genome for targeted genomic integration of the transformation vector. Homology regions may be selected to disrupt one or more genomic sites of endogenous lipid biosynthesis pathway genes. Stable transformation of *Chlorella vulgaris* with the transformation vector is achieved through well-known transformation techniques including electroporation or other known methods. Activity of the hygromycin B resistance gene product can be used as a marker to select for *Chlorella vulgaris* transformed with the transformation vector on, but not limited to, agar medium comprising hygromycin. Growth media suitable for *Chlorella vulgaris* lipid production include, but are not limited to BG11 medium (0.04 g/L $KH_2PO_4$, 0.075 g/L $CaCl_2$, 0.036 g/L citric acid, 0.006 g/L Ammonium Ferric Citrate, 1 mg/L EDTA, and 0.02 g/L $Na_2CO_3$) supplemented with trace metals, and optionally 1.5 g/L NaNO3. Additional media suitable for culturing *Chlorella vulgaris* for lipid production include, for example, Watanabe medium (comprising 1.5 g/L $KNO_3$, 1.25 g/L $KH_2PO_4$, 1.25 g l$^{-1}$ $MgSO_4.7H_2O$, 20 mg l$^{-1}$ $FeSO_4.7H_2O$ with micronutrients and low-nitrogen medium (comprising 203 mg/l $(NH_4)_2HPO_4$, 2.236 g/l KCl, 2.465 g/l $MgSO_4$, 1.361 g/l $KH_2PO_4$ and 10 mg/l $FeSO_4$) as reported by Illman et al., *Enzyme and Microbial Technology*, Vol. 27 (2000), pp. 631-635. Evaluation of fatty acid profiles of *Chlorella vulgaris* lipids can be assessed through standard lipid extraction and analytical methods described herein.

Example 23

Engineering *Chlorella ellipsoidea*

Expression of recombinant genes in accordance with the present invention in *Chlorella ellipsoidea* can be accomplished by modifying the methods and vectors taught by Chen et al. as discussed herein. Briefly, Chen et al., *Current Genetics*, Vol. 39:5 (2001), pp. 365-370, reported the stable transformation of *Chlorella ellipsoidea* with plasmid DNA. Using the transformation method of electroporation, Chen introduced the plasmid pBinUΩNP-1 into *Chlorella ellipsoidea*. The nucleotide sequence of pBinUΩNP-1 comprised sequence encoding the neutrophil peptide-1 (NP-1) rabbit gene product operably linked to a *Zea mays* Ubiquitin (ubi1) gene promoter upstream of the NP-1 protein-coding region and operably linked to the 3' UTR/terminator of the nopaline synthase (nos) gene downstream of the NP-1 protein-coding region. The sequence of plasmid pBinUΩNP-1 further comprised a G418 antibiotic resistance cassette. This G418 antibiotic resistance cassette comprised sequence encoding the aminoglycoside 3'-phosphotransferase (aph 3') gene product. The aph 3' gene product confers resistance to the antibiotic G418. Prior to transformation, *Chlorella ellipsoidea* was unable to be propagated in culture medium comprising 30 ug/mL G418. Upon transformation with the pBinUΩNP-1 plasmid, transformants of *Chlorella ellipsoidea* were obtained that were propagated in selective culture medium comprising 30 ug/mL G418. The expression of the aph 3' gene product in *Chlorella ellipsoidea* enabled propagation of transformed *Chlorella ellipsoidea* in the presence of 30 ug/mL G418, thereby establishing the utility of the G418 antibiotic resistance cassette as selectable marker for use in *Chlorella ellipsoidea*. Detectable activity of the NP-1 gene product indicated that the ubi1 promoter and nos 3' UTR are suitable for enabling heterologous gene expression in *Chlorella ellipsoidea*. Evaluation of the genomic DNA of the stable transformants was performed by Southern analysis. Selection and maintenance of the transformed *Chlorella ellipsoidea* was performed on Knop medium (comprising 0.2 g/L $K_2HPO_4$, 0.2 g/L $MgSO_4.7H_2O$, 0.12 g/L KCl, and 10 mg/L FeCl3, pH 6.0-8.0 supplemented with 0.1% yeast extract and 0.2% glucose) with 15 ug/mL G418 (for liquid cultures) or with 30 ug/mL G418 (for solid cultures comprising 1.8% agar). Propagation of *Chlorella ellipsoidea* in media other than Knop medium has been reported (see Cho et al., *Fisheries Science*, Vol. 73:5 (2007), pp. 1050-1056, Jarvis and Brown, *Current Genetics*, Vol. 19 (1991), pp. 317-321 and Kim et al., *Marine Biotechnology*, Vol. 4 (2002), pp. 63-73). Additional plasmids, promoters, 3'UTR/terminators, and selectable markers suitable for enabling heterologous gene expression in *Chlorella ellipsoidea* have been reported (see Jarvis and Brown and Kim et al., *Marine Biotechnology*, Vol. 4 (2002), pp. 63-73). Chen reported that the plasmid pBinUΩNP-1, the ubi1 promoter, and the *Agrobacterium tumefaciens* nopaline synthase gene 3'UTR/terminator are suitable to enable exogenous gene expression in *Chlorella ellipsoidea*. In addition, Chen reported that the G418 resistance cassette encoded on pBinUΩNP-1 was suitable for use as a selectable marker in *Chlorella ellipsoidea*.

In an embodiment of the present invention, vector pBinUΩNP-1, comprising the nucleotide sequence encoding the aph 3' gene product, conferring resistance to G418, for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Chlorella ellipsoidea* to reflect the codon bias inherent in nuclear genes of *Chlorella ellipsoidea* in accordance with Tables 69A-D. For each lipid biosynthesis pathway protein of Table 70, the codon-optimized gene sequence can individually be operably linked to the *Zea mays* ubi1 promoter upstream of the protein-coding sequence and operably linked to the *Agrobacterium tumefaciens* nopaline synthase gene 3'UTR/terminator at the 3' region, or downstream, of the protein-coding sequence. The transformation construct may additionally comprise homology regions to the *Chlorella ellipsoidea* genome for targeted genomic integration of the transformation vector. Homology regions may be selected to disrupt one or more genomic sites of endogenous lipid biosynthesis pathway genes. Stable transformation of *Chlorella ellipsoidea* with the transformation vector is achieved through well-known transformation techniques including electroporation or other known methods. Activity of the aph 3' gene product can be used as a marker to select for *Chlorella ellipsoidea* transformed with the transformation vector on, but not limited to, Knop agar medium comprising G418. Growth media suitable for *Chlorella ellipsoidea* lipid production include, but are not limited to, Knop medium and those culture medium reported by Jarvis and Brown and Kim et al. Evaluation of fatty acid profiles of Chlorella ellipsoidea lipids can be assessed through standard lipid extraction and analytical methods described herein.

Example 24

Engineering Chlorella kessleri

Expression of recombinant genes in accordance with the present invention in Chlorella kessleri can be accomplished by modifying the methods and vectors taught by El-Sheekh et al. as discussed herein. Briefly, El-Sheekh et al., Biologia Plantarium, Vol. 42:2 (1999), pp. 209-216, reported the stable transformation of Chlorella kessleri with plasmid DNA. Using the transformation method of microprojectile bombardment, El-Sheekh introduced the plasmid pBI121 (GenBank Accession No. AF485783) into Chlorella kessleri. Plasmid pBI121 comprised a kanamycin/neomycin antibiotic resistance cassette. This kanamycin/neomycin antibiotic resistance cassette comprised the Agrobacterium tumefaciens nopaline synthase (nos) gene promoter, sequence encoding the neomycin phosphotransferase II (nptII) gene product (GenBank Accession No. AAL92039) for resistance to kanamycin and G418, and the 3' UTR/terminator of the Agrobacterium tumefaciens nopaline synthase (nos) gene. pBI121 further comprised sequence encoding a beta-glucuronidase (GUS) reporter gene product operably linked to a CaMV 35S promoter and operably linked to a 3' UTR/terminator of the nos gene. Prior to transformation, Chlorella kessleri was unable to be propagated in culture medium comprising 15 ug/L kanamycin. Upon transformation with the pBI121 plasmid, transformants of Chlorella kessleri were obtained that were propagated in selective culture medium comprising 15 mg/L kanamycin. The express ion of the nptII gene product in Chlorella kessleri enabled propagation in the presence of 15 mg/L kanamycin, thereby establishing the utility of the kanamycin/neomycin antibiotic resistance cassette as selectable marker for use in Chlorella kessleri. Detectable activity of the GUS gene product indicated that the CaMV 35S promoter and nos 3' UTR are suitable for enabling heterologous gene expression in Chlorella kessleri. Evaluation of the genomic DNA of the stable transformants was performed by Southern analysis. As reported by El-Sheekh, selection and maintenance of transformed Chlorella kessleri was conducted on semisolid agar plates comprising YEG medium (1% yeast extract, 1% glucose) and 15 mg/L kanamycin. El-Sheekh also reported the propagation of Chlorella kessleri in YEG liquid culture media. Additional media suitable for culturing Chlorella kessleri for lipid production are disclosed in Sato et al., BBA Molecular and Cell Biology of Lipids, Vol. 1633 (2003), pp. 27-34). El-Sheekh reported that the plasmid pBI121, the CaMV promoter, and the nopaline synthase gene 3'UTR/terminator are suitable to enable heterologous gene expression in Chlorella kessleri. In addition, El-Sheekh reported that the kanamycin/neomycin resistance cassette encoded on pBI121 was suitable for use as a selectable marker in Chlorella kessleri.

In an embodiment of the present invention, vector pBI121, comprising the nucleotide sequence encoding the kanamycin/neomycin resistance gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in Chlorella kessleri to reflect the codon bias inherent in nuclear genes of Chlorella kessleri in accordance with Tables 69A-D. For each lipid biosynthesis pathway protein of Table 70, the codon-optimized gene sequence can individually be operably linked to the CaMV 35S promoter upstream of the protein-coding sequence and operably linked to the Agrobacterium tumefaciens nopaline synthase gene 3'UTR/terminator at the 3' region, or downstream, of the protein-coding sequence. The transformation construct may additionally comprise homology regions to the Chlorella kessleri genome for targeted genomic integration of the transformation vector. Homology regions may be selected to disrupt one or more genomic sites of endogenous lipid biosynthesis pathway genes. Stable transformation of Chlorella kessleri with the transformation vector is achieved through well-known transformation techniques including microprojectile bombardment or other known methods. Activity of the nptII gene product can be used as a marker to select for Chlorella kessleri transformed with the transformation vector on, but not limited to, YEG agar medium comprising kanamycin or neomycin. Growth media suitable for Chlorella kessleri lipid production include, but are not limited to, YEG medium, and those culture media reported by Sato et al. Evaluation of fatty acid profiles of Chlorella kessleri lipids can be assessed through standard lipid extraction and analytical methods described herein.

Example 25

Engineering Dunaliella tertiolecta

Expression of recombinant genes in accordance with the present invention in Dunaliella tertiolecta can be accomplished by modifying the methods and vectors taught by Walker et al. as discussed herein. Briefly, Walker et al., Journal of Applied Phycology, Vol. 17 (2005), pp. 363-368, reported stable nuclear transformation of Dunaliella tertiolecta with plasmid DNA. Using the transformation method of electroporation, Walker introduced the plasmid pDbleFLAG1.2 into Dunaliella tertiolecta. pDbleFLAG1.2 comprised sequence encoding a bleomycin antibiotic resistance cassette, comprising sequence encoding the Streptoalloteichus hindustanus Bleomycin binding protein (ble), for resistance to the antibiotic phleomycin, operably linked to the promoter and 3' UTR of the Dunaliella tertiolecta ribulose-1,5-bisphosphate carboxylase/oxygenase small subunit gene (rbcS1, GenBank Accession No. AY530155). Prior to transformation, Dunaliella tertiolecta was unable to be propagated in culture medium comprising 1 mg/L phleomycin. Upon transformation with the pDbleFLAG1.2 plasmid, transformants of Dunaliella tertiolecta were obtained that were propagated in selective culture medium comprising 1 mg/L phleomycin. The expression of the ble gene product in Dunaliella tertiolecta enabled propagation in the presence of 1 mg/L phleomycin, thereby establishing the utility of the bleomycin antibiotic resistance cassette as selectable marker for use in Dunaliella tertiolecta. Evaluation of the genomic DNA of the stable transformants was performed by Southern analysis. As reported by Walker, selection and maintenance of transformed Dunaliella tertiolecta was conducted in Dunaliella medium (DM, as described by Provasoli et al., Archiv fur Mikrobiologie, Vol. 25 (1957), pp. 392-428) further comprising 4.5 g/L NaCl and 1 mg/L pheomycin. Additional media suitable for culturing Dunaliella tertiolecta for lipid production are discussed in Takagi et al., Journal of Bioscience and Bioengineering, Vol. 101:3 (2006), pp. 223-226 and in Massart and Hanston, Proceedings Venice 2010, Third International Symposium on Energy from Biomass and Waste. Walker reported that the plasmid pDbleFLAG1.2 and the promoter and 3' UTR of the Dunaliella tertiolecta ribulose-1,5-bisphosphate carboxylase/oxygenase small subunit gene are suitable to enable heterologous expression in Dunaliella tertiolecta. In addition, Walker reported that the bleomycin resistance cassette encoded on pDbleFLAG1.2 was suitable for use as a selectable marker in Dunaliella tertiolecta.

In an embodiment of the present invention, vector pDble-FLAG1.2, comprising the nucleotide sequence encoding the ble gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Dunaliella tertiolecta* to reflect the codon bias inherent in nuclear genes of *Dunaliella tertiolecta* in accordance with Tables 69A-D. For each lipid biosynthesis pathway protein of Table 70, the codon-optimized gene sequence can individually be operably linked to the rbcS1 promoter upstream of the protein-coding sequence and operably linked to the rbcS1 3'UTR/terminator at the 3' region, or downstream, of the protein-coding sequence. The transformation construct may additionally comprise homology regions to the *Dunaliella tertiolecta* genome for targeted genomic integration of the transformation vector. Homology regions may be selected to disrupt one or more genomic sites of endogenous lipid biosynthesis pathway genes. Stable transformation of *Dunaliella tertiolecta* with the transformation vector is achieved through well-known transformation techniques including electroporation or other known methods. Activity of the ble gene product can be used as a marker to select for *Dunaliella tertiolecta* transformed with the transformation vector on, but not limited to, DM medium comprising pheomycin. Growth medium suitable for *Dunaliella tertiolecta* lipid production include, but are not limited to DM medium and those culture media described by Takagi et al. and Massart and Hanston. Evaluation of fatty acid profiles of *Dunaliella tertiolecta* lipids can be assessed through standard lipid extraction and analytical methods described herein.

Example 26

Engineering *Volvox carteri*

Expression of recombinant genes in accordance with the present invention in *Volvox carteri* can be accomplished by modifying the methods and vectors taught by Hallman and Rappel et al. as discussed herein. Briefly, Hallman and Rappel et al., *The Plant Journal*, Volume 17 (1999), pp. 99-109, reported the stable nuclear transformation of *Volvox carteri* with plasmid DNA. Using the transformation method of microprojectile bombardment, Hallman and Rappel introduced the pzeoE plasmid into *Volvox carteri*. The pzeoE plasmid comprised sequence encoding a bleomycin antibiotic resistance cassette, comprising sequence encoding the *Streptoalloteichus hindustanus* Bleomycin binding protein (ble), for resistance to the antibiotic zeocin, operably linked to and the promoter and 3' UTR of the *Volvox carteri* beta-tubulin gene (GenBank Accession No. L24547). Prior to transformation, *Volvox carteri* was unable to be propagated in culture medium comprising 1.5 ug/ml zeocin. Upon transformation with the pzeoE plasmid, transformants of *Volvox carteri* were obtained that were propagated in selective culture medium comprising greater than 20 ug/ml zeocin. The expression of the ble gene product in *Volvox carteri* enabled propagation in the presence of 20 ug/ml zeocin, thereby establishing the utility of the bleomycin antibiotic resistance cassette as selectable marker for use in *Volvox carteri*. Evaluation of the genomic DNA of the stable transformants was performed by Southern analysis. As reported by Hallman and Rappel, selection and maintenance of transformed *Volvox carteri* was conducted in *Volvox* medium (VM, as described by Provasoli and Pintner, The Ecology of Algae, Special Publication No. 2 (1959), Tyron, C. A. and Hartman, R. T., eds., Pittsburgh: University of Pittsburgh, pp. 88-96) with 1 mg/L pheomycin. Media suitable for culturing *Volvox carteri* for lipid production are also discussed by Starr in Starr R, C., *Dev Biol* Suppl., Vol. 4 (1970), pp. 59-100). Hallman and Rappel reported that the plasmid pzeoE and the promoter and 3' UTR of the *Volvox carteri* beta-tubulin gene are suitable to enable heterologous expression in *Volvox carteri*. In addition, Hallman and Rappel reported that the bleomycin resistance cassette encoded on pzeoE was suitable for use as a selectable marker in *Volvox carteri*. Additional plasmids, promoters, 3'UTR/terminators, and selectable markers suitable for enabling heterologous gene expression in *Volvox carteri* and suitable for use as selective markers *Volvox carteri* in have been reported (for instance see Hallamann and Sumper, *Proceedings of the National Academy of Sciences*, Vol. 91 (1994), pp 11562-11566 and Hallman and Wodniok, *Plant Cell Reports*, Volume 25 (2006), pp. 582-581).

In an embodiment of the present invention, vector pzeoE, comprising the nucleotide sequence encoding the ble gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Volvox carteri* to reflect the codon bias inherent in nuclear genes of *Volvox carteri* in accordance with Tables 69A-D. For each lipid biosynthesis pathway protein of Table 70, the codon-optimized gene sequence can individually be operably linked to the *Volvox carteri* beta-tubulin promoter upstream of the protein-coding sequence and operably linked to the *Volvox carteri* beta-tubulin 3'UTR/terminator at the 3' region, or downstream, of the protein-coding sequence. The transformation construct may additionally comprise homology regions to the *Volvox carteri* genome for targeted genomic integration of the transformation vector. Homology regions may be selected to disrupt one or more genomic sites of endogenous lipid biosynthesis pathway genes. One skilled in the art can identify such homology regions within the sequence of the *Volvox carteri* genome (referenced in the publication by Prochnik et al., *Science*, Vol. 329:5988 (2010), pp 223-226). Stable transformation of *Volvox carteri* with the transformation vector is achieved through well-known transformation techniques including microprojectile bombardment or other known methods. Activity of the ble gene product can be used as a marker to select for *Volvox carteri* transformed with the transformation vector on, but not limited to, VM medium comprising zeocin. Growth medium suitable for *Volvox carteri* lipid production include, but are not limited to VM medium and those culture media discussed by Starr. Evaluation of fatty acid profiles of *Volvox carteri* lipids can be assessed through standard lipid extraction and analytical methods described herein.

Example 27

Engineering *Haematococcus pluvialis*

Expression of recombinant genes in accordance with the present invention in *Haematococcus pluvialis* can be accomplished by modifying the methods and vectors taught by Steinbrenner and Sandmann et al. as discussed herein. Briefly, Steinbrenner and Sandmann et al., *Applied and Environmental Microbiology*, Vol. 72:12 (2006), pp. 7477-7484, reported the stable nuclear transformation of *Haematococcus pluvialis* with plasmid DNA. Using the transformation method of microprojectile bombardment, Steinbrenner introduced the plasmid pPlat-pds-L504R into *Haematococcus pluvialis*. The plasmid pPlat-pds-L504R comprised a norflurazon resistance cassette, which comprised the promoter, protein-coding sequence, and 3'UTR of the *Haematococcus pluvialis* phytoene desaturase gene (Pds, GenBank Accession No. AY781170), wherein the protein-coding sequence of Pds was modified at position 504 (thereby changing a leucine to an arginine) to encode a gene product (Pds-L504R) that confers resistance to the herbicide norflurazon. Prior to transformation with pPlat-pds-L504R, *Haematococcus pluvialis* was unable to propagate on medium comprising 5 uM norflurazon. Upon transformation with the pPlat-pds-L504R plasmid, transformants of *Haematococcus pluvialis* were obtained that were propagated in selective culture medium comprising 5 uM norflurazon. The expression of the Pds-L504R gene product in *Haematococcus pluvialis* enabled propagation in the presence of 5 uM norflurazon, thereby establishing the utility of the norflurazon herbicide resistance cassette as selectable marker for use in *Haematococcus pluvialis*. Evaluation of the genomic DNA of the stable transformants was performed by Southern analysis. As reported by Steinbrenner, selection and maintenance of transformed *Haematococcus pluvialis* was conducted on agar plates comprising OHA medium (OHM (0.41 g/L $KNO_3$, 0.03 g/L $Na_2HPO_4$, 0.246 g/L $MgSO_4.7H_2O$, 0.11 g/L $CaCl_2.2H_2O$, 2.62 mg/L $Fe_{(III)}$ citrate×$H_2O$, 0.011 mg/L $CoCl_2.6H_2O$, 0.012 mg/L $CuSO_4.5H_2O$, 0.075 mg/L $Cr_2O_3$, 0.98 mg/L $MnCl_2.4H_2O$, 0.12 mg/L $Na_2MoO_4\times2H_2O$, 0.005 mg/L $SeO_2$ and 25 mg/L biotin, 17.5 mg/L thiamine, and 15 mg/L vitamin B12), supplemented with 2.42 g/L Tris-acetate, and 5 mM norflurazon. Propagation of *Haematococcus pluvialis* in liquid culture was performed by Steinbrenner and Sandmann using basal medium (basal medium as described by Kobayashi et al., *Applied and Environmental Microbiology*, Vol. 59 (1993), pp. 867-873). Steinbrenner and Sandmann reported that the pPlat-pds-L504R plasmid and promoter and 3' UTR of the *Haematococcus pluvialis* phytoene desaturase gene are suitable to enable heterologous expression in *Haematococcus pluvialis*. In addition, Steinbrenner and Sandmann reported that the norflurazon resistance cassette encoded on pPlat-pds-L504R was suitable for use as a selectable marker in *Haematococcus pluvialis*. Additional plasmids, promoters, 3'UTR/terminators, and selectable markers suitable for enabling heterologous gene expression in *Haematococcus pluvialis* have been reported (see Kathiresan et al., *Journal of Phycology*, Vol. 45 (2009), pp 642-649).

In an embodiment of the present invention, vector pPlat-pds-L504R, comprising the nucleotide sequence encoding the Pds-L504R gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Haematococcus pluvialis* to reflect the codon bias inherent in nuclear genes of *Haematococcus pluvialis* in accordance with Tables 69A-D. For each lipid biosynthesis pathway protein of Table 70, the codon-optimized gene sequence can individually be operably linked to the *Haematococcus pluvialis* pds gene promoter upstream of the protein-coding sequence and operably linked to the *Haematococcus pluvialis* pds gene 3'UTR/terminator at the 3' region, or downstream, of the protein-coding sequence. The transformation construct may additionally comprise homology regions to the *Haematococcus pluvialis* genome for targeted genomic integration of the transformation vector. Homology regions may be selected to disrupt one or more genomic sites of endogenous lipid biosynthesis pathway genes. Stable transformation of *Haematococcus pluvialis* with the transformation vector is achieved through well-known transformation techniques including microprojectile bombardment or other known methods. Activity of the Pds-L504R gene product can be used as a marker to select for *Haematococcus pluvialis* transformed with the transformation vector on, but not limited to, OHA medium comprising norflurazon. Growth media suitable for *Haematococcus pluvialis* lipid production include, but are not limited to basal medium and those culture media described by Kobayashi et al., Kathiresan et al, and Gong and Chen, *Journal of Applied Phycology*, Vol. 9:5 (1997), pp. 437-444). Evaluation of fatty acid profiles of *Haematococcus pluvialis* lipids can be assessed through standard lipid extraction and analytical methods described herein.

Example 28

Engineering *Closterium peracerosum-strigosum-littorale complex*

Expression of recombinant genes in accordance with the present invention in *Closterium peracerosum-strigosum-littorale* complex can be accomplished by modifying the methods and vectors taught by Abe et al. as discussed herein. Briefly, Abe et al., *Plant Cell Physiology*, Vol. 52:9 (2011), pp. 1676-1685, reported the stable nuclear transformation of *Closterium peracerosum-strigosum-littorale* complex with plasmid DNA. Using the transformation methods of microprojectile bombardment, Abe introduced the plasmid pSA106 into *Closterium peracerosum-strigosum-littorale* complex. Plasmid pSA106 comprised a bleomycin resistance cassette, comprising sequence encoding the *Streptoalloteichus hindustanus* Bleomycin binding protein gene (ble, GenBank Accession No. CAA37050) operably linked to the promoter and 3' UTR of the *Closterium peracerosum-strigosum-littorale* complex Chlorophyll a/b-binding protein gene (CAB, GenBank Accession No. AB363403). Prior to transformation with pSA106, *Closterium peracerosum-strigosum-littorale* complex was unable to propagate on medium comprising 3 ug/ml phleomycin. Upon transformation with pSA106, transformants of *Closterium peracerosum-strigosum-littorale* complex were obtained that were propagated in selective culture medium comprising 3 ug/ml phleomycin. The expression of the ble gene product in *Closterium peracerosum-strigosum-littorale* complex enabled propagation in the presence of 3 ug/ml phleomycin, thereby establishing the utility of the bleomycin antibiotic resistance cassette as selectable marker for use in *Closterium peracerosum-strigosum-littorale* complex. Evaluation of the genomic DNA of the stable transformants was performed by Southern analysis. As reported by Abe, selection and maintenance of transformed *Closterium peracerosum-strigosum-littorale* complex was conducted first in top agar with C medium (0.1 g/L $KNO_3$, 0.015 g/L $Ca(NO_3)_2.4H_2O$, 0.05 g/L glycerophosphate-Na2, 0.04 g/L $MgSO_4.7H_2O$, 0.5 g/L Tris(hydroxylmethyl)aminomethane, trace minerals, biotin, vitamins $B_1$ and $B_{12}$) and then subsequently isolated to agar plates comprising C medium supplemented with phleomycin. As reported by Abe, propagation of *Closterium peracerosum-strigosum-littorale* complex in liquid culture was performed in C medium. Additional liquid culture medium suitable for propagation of *Closterium peracerosum-strigosum-littorale* complex are discussed by Sekimoto et al., *DNA Research*, 10:4 (2003), pp. 147-153. Abe reported that the pSA106 plasmid and promoter and 3' UTR of the *Closterium peracerosum-strigosum-littorale* complex CAB gene are suitable to enable heterologous gene expression in *Closterium peracerosum-strigosum-littorale* complex. In addition, Abe reported that the bleomycin resistance cassette encoded on pSA106 was suitable for use as a selectable marker in *Closterium peracerosum-strigosum-littorale* complex. Additional plasmids, promoters, 3'UTR/terminators, and selectable markers suitable for enabling heterologous gene expression in *Closterium peracerosum-strigosum-littorale* complex have been reported (see Abe et al., *Plant Cell Physiology, Vol. 49* (2008), pp. 625-632).

In an embodiment of the present invention, vector pSA106, comprising the nucleotide sequence encoding the ble gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Closterium peracerosum-strigosum-littorale* complex to reflect the codon bias inherent in nuclear genes of *Closterium peracerosum-strigosum-littorale* complex in accordance with Tables 69A-D. For each lipid biosynthesis pathway protein of Table 70, the codon-optimized gene sequence can individually be operably linked to the *Closterium peracerosum-strigosum-littorale* complex CAB gene promoter upstream of the protein-coding sequence and operably linked to the *Closterium peracerosum-strigosum-littorale* complex CAB gene 3'UTR/terminator at the 3' region, or downstream, of the protein-coding sequence. The transformation construct may additionally comprise homology regions to the *Closterium peracerosum-strigosum-littorale* complex genome for targeted genomic integration of the transformation vector. Homology regions may be selected to disrupt one or more genomic sites of endogenous lipid biosynthesis pathway genes. Stable transformation of *Closterium peracerosum-strigosum-littorale* complex with the transformation vector is achieved through well-known transformation techniques including microprojectile bombardment or other known methods. Activity of the ble gene product can be used as a marker to select for *Closterium peracerosum-strigosum-littorale* complex transformed with the transformation vector on, but not limited to, C medium comprising phleomycin. Growth media suitable for *Closterium peracerosum-strigosum-littorale* complex lipid production include, but are not limited to C medium and those culture media reported by Abe et al. and Sekimoto et al. Evaluation of fatty acid profiles of *Closterium peracerosum-strigosum-littorale* complex lipids can be assessed through standard lipid extraction and analytical methods described herein.

Example 29

Engineering *Dunaliella viridis*

Expression of recombinant genes in accordance with the present invention in *Dunaliella viridis* can be accomplished by modifying the methods and vectors taught by Sun et al. as discussed herein. Briefly, Sun et al., *Gene*, Vol. 377 (2006), pp. 140-149, reported the stable transformation of *Dunaliella viridis* with plasmid DNA. Using the transformation method of electoporation, Sun introduced the plasmid pDVNR, encoding the full *Dunaliella viridis* nitrate reductase gene into mutant *Dunaliella viridis* (*Dunaliella viridis* NR-mutants.) The NR-mutants are incapable of growth without the use of nitrate as a source of nitrogen. Nitrate reductase catalyzes the conversion of nitrate to nitrite. Prior to transformation, *Dunaliella viridis* NR-mutants were unable to propagate in culture medium comprising nitrate ($NO_3^-$) as the sole nitrogen source. The expression of the *Dunaliella viridis* NR gene product in NR-mutant *Dunaliella viridis* was used as a selectable marker to rescue the nitrate metabolism deficiency. Upon transformation with the pDVNR plasmid, NR-mutant *Dunaliella viridis* stably expressing the *Dunaliella viridis* NR gene product were obtained that were able to grow on agar plates comprising nitrate as the sole carbon source. Evaluation of the DNA of the stable transformants was performed by Southern analysis. Selection and maintenance of the transformed *Dunaliella viridis* (NR mutant) was performed on agar plates comprising 5 mM $KNO_3$. Sun also reported the propagation of *Dunaliella viridis* and *Dunaliella viridis* NR mutants in liquid culture medium. Additional media suitable for propagation of *Dunaliella viridis* are reported by Gordillo et al., *Journal of Applied Phycology*, Vol. 10:2 (1998), pp. 135-144 and by Moulton and Burford, *Hydrobiologia*, Vols. 204-205:1 (1990), pp. 401-408. Sun reported that the plasmid pDVNR and the promoter and 3' UTR/terminator of the *Dunaliella viridis* nitrate reductase gene were suitable to enable heterologous expression in *Dunaliella viridis* NR-mutants. Sun also reported that expression of the *Dunaliella viridis* nitrate reductase gene product was suitable for use as a selectable marker in *Dunaliella viridis* NR-mutants.

In an embodiment of the present invention, vector pDVNR, comprising the nucleotide sequence encoding the *Dunaliella viridis* nitrate reductase (DvNR) gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Dunaliella viridis* to reflect the codon bias inherent in nuclear genes of *Dunaliella viridis* in accordance with Tables 69A-D. For each lipid biosynthesis pathway protein of Table 70, the codon-optimized gene sequence can individually be operably linked to the DvNR promoter upstream of the protein-coding sequence and operably linked to the DvNR 3'UTR/terminator at the 3' region, or downstream, of the protein-coding sequence. The transformation construct may additionally comprise homology regions to the *Dunaliella viridis* genome for targeted genomic integration of the transformation vector. Homology regions may be selected to disrupt one or more genomic sites of endogenous lipid biosynthesis pathway genes. Stable transformation of *Dunaliella viridis* NR mutants with the transformation vector is achieved through well-known transformation techniques including electroporation or other known methods. Activity of the DvNR gene product can be used as a selectable marker to rescue the nitrogen assimiliation deficiency of *Dunaliella viridis* NR mutant strains and to select for *Dunaliella viridis* NR-mutants stably expressing the transformation vector. Growth media suitable for *Dunaliella viridis* lipid production include, but are not limited to those discussed by Sun et al., Moulton and Burford, and Gordillo et al. Evaluation of fatty acid profiles of *Dunaliella viridis* lipids can be assessed through standard lipid extraction and analytical methods described herein.

Example 30

Engineering *Dunaliella salina*

Expression of recombinant genes in accordance with the present invention in *Dunaliella salina* can be accomplished by modifying the methods and vectors taught by Geng et al. as discussed herein. Briefly, Geng et al., *Journal of Applied Phycology*, Vol. 15 (2003), pp. 451-456, reported the stable transformation of *Dunaliella salina* with plasmid DNA. Using the transformation method of electroporation, Geng introduced the pUΩHBsAg-CAT plasmid into *Dunaliella salina*. pUΩHBsAg-CAT comprises a hepatitis B surface antigen (HBsAG) expression cassette comprising sequence encoding the hepatitis B surface antigen operably linked to a *Zea mays* ubi1 promoter upstream of the HBsAG protein-coding region and operably linked to the 3'UTR/terminator of the *Agrobacterium tumefaciens* nopaline synthase gene (nos) downstream of the HBsAG protein-coding region. pUΩHBsAg-CAT further comprised a chloramphenicol resistance cassette, comprising sequence encoding the chloramphenicol acetyltransferase (CAT) gene product, conferring resistance to the antibiotic chloramphenicol, operably linked to the simian virus 40 promoter and enhancer. Prior to transformation with pUfΩHBsAg-CAT, *Dunaliella salina* was unable to propagate on medium comprising 60 mg/L chloramphenicol. Upon transformation with the pUΩHBsAg-CAT plasmid, transformants of *Dunaliella salina* were obtained that were propagated in selective culture medium comprising 60 mg/L chloramphenicol. The expression of the CAT gene product in *Dunaliella salina* enabled propagation in the presence of 60 mg/L chloramphenicol, thereby establishing the utility of the chloramphenicol resistance cassette as selectable marker for use in *Dunaliella salina*. Detectable activity of the HBsAg gene product indicated that ubi1 promoter and nos 3'UTR/ terminator are suitable for enabling gene expression in *Dunaliella salina*. Evaluation of the genomic DNA of the stable transformants was performed by Southern analysis. Geng reported that selection and maintenance of the transformed *Dunaliella salina* was performed on agar plates comprising Johnson's medium (J1, described by Borowitzka and Borowitzka (eds), Micro-algal Biotechnology. Cambridge University Press, Cambridge, pp. 460-461) with 60 mg/L chloramphenicol. Liquid propagation of *Dunaliella salina* was performed by Geng in J1 medium with 60 mg/L chloramphenicol. Propagation of *Dunaliella salina* in media other than J1 medium has been discussed (see Feng et al., *Mol. Bio. Reports*, Vol. 36 (2009), pp. 1433-1439 and Borowitzka et al., *Hydrobiologia*, Vols. 116-117:1 (1984), pp. 115-121). Additional plasmids, promoters, 3'UTR/terminators, and selectable markers suitable for enabling heterologous gene expression in *Dunaliella salina* have been reported by Feng et al. Geng reported that the plasmid pUΩHBsAg-CAT, the ubi1 promoter, and the *Agrobacterium tumefaciens* nopaline synthase gene 3'UTR/terminator are suitable to enable exogenous gene expression in *Dunaliella salina*. In addition, Geng reporteds that the CAT resistance cassette encoded on pUΩ-HBsAg-CAT was suitable for use as a selectable marker in *Dunaliella salina*.

In an embodiment of the present invention, vector pUΩH-BsAg-CAT, comprising the nucleotide sequence encoding the CAT gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Dunaliella salina* to reflect the codon bias inherent in nuclear genes of *Dunaliella salina* in accordance with Tables 69A-D. For each lipid biosynthesis pathway protein of Table 70, the codon-optimized gene sequence can individually be operably linked to the ubi1 promoter upstream of the protein-coding sequence and operably linked to the *Agrobacterium tumefaciens* nopaline synthase gene 3'UTR/terminator at the 3' region, or downstream, of the protein-coding sequence. The transformation construct may additionally comprise homology regions to the *Dunaliella salina* genome for targeted genomic integration of the transformation vector. Homology regions may be selected to disrupt one or more genomic sites of endogenous lipid biosynthesis pathway genes. Stable transformation of *Dunaliella salina* with the transformation vector is achieved through well-known transformation techniques including electroporation or other known methods. Activity of the CAT gene product can be used as a selectable marker to select for *Dunaliella salina* transformed with the transformation vector in, but not limited to, J1 medium comprising chloramphenicol. Growth medium suitable for *Dunaliella salina* lipid production include, but are not limited to J1 medium and those culture media described by Feng et al. and Borowitzka et al. Evaluation of fatty acid profiles of *Dunaliella salina* lipids can be assessed through standard lipid extraction and analytical methods described herein.

Example 31

Engineering *Gonium pectoral*

Expression of recombinant genes in accordance with the present invention in *Gonium pectoral* can be accomplished by modifying the methods and vectors taught by Lerche and Hallman et al. as discussed herein. Briefly, Lerche and Hallman et al., *BMC Biotechnology*, Volume 9:64, 2009, reported the stable nuclear transformation of *Gonium pectorale* with plasmid DNA. Using the transformation method of microprojectile bombardment, Lerche introduced the plasmid pPmr3 into *Gonium pectorale*. Plasmid pPmr3 comprised a paromomycin resistance cassette, comprising a sequence encoding the aminoglycoside 3'-phosphotransferase (aph-VIII) gene product (GenBank Accession No. AAB03856) of *Streptomyces rimosus* for resistance to the antibiotic paromomycin, operably linked to the *Volvox carteri* hsp70A-rbcS3 hybrid promoter upstream of the aphVIII protein-coding region and operably linked to the 3' UTR/terminator of the *Volvox carteri* rbcS3 gene downstream of the aphVIII protein-coding region. Prior to transformation with pPmr3, *Gonium pectorale* was unable to propagate on medium comprising 0.06 ug/ml paromomycin. Upon transformation with pPmr3, transformants of *Gonium pectorale* were obtained that were propagated in selective culture medium comprising 0.75 and greater ug/ml paromomycin. The expression of the aphVIII gene product in *Gonium pectorale* enabled propagation in the presence of 0.75 and greater ug/ml paromomycin, thereby establishing the utility of the paromomycin antibiotic resistance cassette as selectable marker for use in *Gonium pectorale*. Evaluation of the genomic DNA of the stable transformants was performed by Southern analysis. Lerche and Hallman reported that selection and maintenance of the transformed *Gonium pectorale* was performed in liquid Jaworski's medium (20 mg/L Ca(NO$_3$)$_2$.4H$_2$O, 12.4 mg/L KH$_2$PO$_4$, 50 mg/L MgSO$_4$.7H$_2$O, 15.9 mg/L NaHCO$_3$, 2.25 mg/L EDTA-FeNa, 2.25 mg/L EDTA Na$_2$, 2.48 g/L H$_3$BO$_3$, 1.39 g/L MnCl$_2$.4H$_2$O, 1 mg/L (NH$_4$)$_6$MO$_7$O$_2$.4H$_2$O, 0.04 mg/L vitamin B12, 0.04 mg/L Thiamine-HCl, 0.04 mg/L biotin, 80 mg/L NaNO$_3$, 36 mg/L Na$_4$HPO$_4$.12H$_2$O) with 1.0 ug/ml paromomycin. Additional plasmids, promoters, 3'UTR/terminators, and selectable markers suitable for enabling heterologous gene expression in *Gonium pectorale* are further discussed by Lerche and Hallman. Lerche and Hallman reported that the plasmid pPmr3, *Volvox carteri* hsp70A-rbcS3 hybrid promoter, and the 3' UTR/terminator of the *Volvox carteri* rbcS3 gene are suitable to enable exogenous gene expression in *Gonium pectorale*. In addition, Lerche and Hallman reported that the paromomycin resistance cassette encoded pPmr3 was suitable for use as a selectable marker in *Gonium pectorale*.

In an embodiment of the present invention, vector pPmr3, comprising the nucleotide sequence encoding the aphVIII gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Gonium pectorale* to reflect the codon bias inherent in nuclear genes of *Gonium pectorale* in accordance with Tables 69A-D. For each lipid biosynthesis pathway protein of Table 70, the codon-optimized gene sequence can individually be operably linked to the *Volvox carteri* hsp70A-rbcS3 hybrid promoter upstream of the protein-coding sequence and operably linked to the *Volvox carteri* rbcS3 gene 3'UTR/terminator at the 3' region, or downstream, of the protein-coding sequence. The transformation construct may additionally comprise homology regions to the *Gonium pectorale* genome for targeted genomic integration of the transformation vector. Homology regions may be selected to disrupt one or more genomic sites of endogenous lipid biosynthesis pathway genes. Stable transformation of *Gonium pectorale* with the transformation vector can be achieved through well-known transformation techniques including microprojectile bombardment or other known methods. Activity of the aphVIII gene product can be used as a selectable marker to select for *Gonium pectorale* transformed with the transformation vector in, but not limited to, Jaworski's medium comprising paromomycin. Growth media suitable for *Gonium pectorale* lipid production include Jawaorski's medium and media reported by Stein, American Journal of Botany, Vol. 45:9 (1958), pp. 664-672. Evaluation of fatty acid profiles of *Gonium pectorale* lipids can be assessed through standard lipid extraction and analytical methods described herein.

Example 32

Engineering *Phaeodactylum tricornutum*

Expression of recombinant genes in accordance with the present invention in *Phaeodactylum tricornutum* can be accomplished by modifying the methods and vectors taught by Apt et al. as discussed herein. Briefly, Apt et al., *Molecular and General Genetics*, Vol. 252 (1996), pp. 572-579, reported the stable nuclear transformation of *Phaeodactylum tricornutum* with vector DNA. Using the transformation technique of microprojectile bombardment, Apt introduced the plasmid pfcpA into *Phaeodactylum tricornutum*. Plasmid pfcpA comprised a bleomycin resistance cassette, comprising sequence encoding the *Streptoalloteichus hindustanus* Bleomycin binding protein (ble), for resistance to the antibiotics phleomycin and zeocin, operably linked to the promoter of the *Phaeodactylum tricornutum* fucoxanthin chlorophyll a binding protein gene (fcpA) upstream of the ble protein-coding region and operably linked to the 3' UTR/terminator of the *Phaeodactylum tricornutum* fcpA gene at the 3' region, or downstream of the ble protein-coding region. Prior to transformation with pfcpA, *Phaeodactylum tricornutum* was unable to propagate on medium comprising 50 ug/ml zeocin. Upon transformation with pfcpA, transformants of *Phaeodactylum tricornutum* were obtained that were propagated in selective culture medium comprising 50 ug/ml zeocin. The expression of the ble gene product in *Phaeodactylum tricornutum* enabled propagation in the presence of 50 ug/ml zeocin, thereby establishing the utility of the bleomycin antibiotic resistance cassette as selectable marker for use in *Phaeodactylum tricornutum*. Evaluation of the genomic DNA of the stable transformants was performed by Southern analysis. Apt reported that selection and maintenance of the transformed *Phaeodactylum tricornutum* was performed on agar plates comprising LDM medium (as reported by Starr and Zeikus, *Journal of Phycology*, Vol. 29, Supplement, (1993)) with 50 mg/L zeocin. Apt reported liquid propagation of *Phaeodactylum tricornutum* transformants in LDM medium with 50 mg/L zeocin. Propagation of *Phaeodactylum tricornutum* in medium other than LDM medium has been discussed (by Zaslayskaia et al., *Science*, Vol. 292 (2001), pp. 2073-2075, and by Radokovits et al., *Metabolic Engineering*, Vol. 13 (2011), pp. 89-95). Additional plasmids, promoters, 3'UTR/terminators, and selectable markers suitable for enabling heterologous gene expression in *Phaeodactylum tricornutum* have been reported in the same report by Apt et al., by Zaslayskaia et al., and by Radokovits et al.). Apt reported that the plasmid pfcpA, and the *Phaeodactylum tricornutum* fcpA promoter and 3' UTR/terminator are suitable to enable exogenous gene expression in *Phaeodactylum tricornutum*. In addition, Apt reported that the bleomycin resistance cassette encoded on pfcpA was suitable for use as a selectable marker in *Phaeodactylum tricornutum*.

In an embodiment of the present invention, vector pfcpA, comprising the nucleotide sequence encoding the ble gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Phaeodactylum tricornutum* to reflect the codon bias inherent in nuclear genes of *Phaeodactylum tricornutum* in accordance with Tables 69A-D. For each lipid biosynthesis pathway protein of Table 70, the codon-optimized gene sequence can individually be operably linked to the *Phaeodactylum tricornutum* fcpA gene promoter upstream of the protein-coding sequence and operably linked to the *Phaeodactylum tricornutum* fcpA gene 3'UTR/terminator at the 3' region, or downstream, of the protein-coding sequence. The transformation construct may additionally comprise homology regions to the *Phaeodactylum tricornutum* genome for targeted genomic integration of the transformation vector. Homology regions may be selected to disrupt one or more genomic sites of endogenous lipid biosynthesis pathway genes. One skilled in the art can identify such homology regions within the sequence of the *Phaeodactylum tricornutum* genome (referenced in the publication by Bowler et al., *Nature*, Vol. 456 (2008), pp. 239-244). Stable transformation of *Phaeodactylum tricornutum* with the transformation vector is achieved through well-known transformation techniques including microprojectile bombardment or other known methods. Activity of the ble gene product can be used as a marker to select for *Phaeodactylum tricornutum* transformed with the transformation vector in, but not limited to, LDM medium comprising paromomycin. Growth medium suitable for *Phaeodactylum tricornutum* lipid production include, but are not limited to f/2 medium as reported by Radokovits et al. Evaluation of fatty acid profiles of *Phaeodactylum tricornutum* lipids can be assessed through standard lipid extraction and analytical methods described herein.

Example 33

Engineering *Chaetoceros* sp.

Expression of recombinant genes in accordance with the present invention in *Chaetoceros* sp. can be accomplished by modifying the methods and vectors taught by Yamaguchi et al. as discussed herein. Briefly, Yamaguchi et al., *Phycological Research*, Vol. 59:2 (2011), pp. 113-119, reported the stable nuclear transformation of *Chaetoceros* sp. with plasmid DNA. Using the transformation method of microprojectile bombardment, Yamaguchi introduced the plasmid pTpfcp/nat into *Chaetoceros* sp. pTpfcp/nat comprised a nourseothricin resistance cassette, comprising sequence encoding the nourseothricin acetyltransferase (nat) gene product (GenBank Accession No. AAC60439) operably linked to the *Thalassiosira pseudonana* fucoxanthin chlorophyll a/c binding protein gene (fcp) promoter upstream of the nat protein-coding region and operably linked to the *Thalassiosira pseudonana* fcp gene 3' UTR/terminator at the 3' region (downstream of the nat protein coding-sequence). The nat gene product confers resistance to the antibiotic nourseothricin. Prior to transformation with pTpfcp/nat, *Chaetoceros* sp. was unable to propagate on medium comprising 500 ug/ml nourseothricin. Upon transformation with pTpfcp/nat, transformants of *Chaetoceros* sp. were obtained that were propagated in selective culture medium comprising 500 ug/ml nourseothricin. The expression of the nat gene product in *Chaetoceros* sp. enabled propagation in the presence of 500 ug/ml nourseothricin, thereby establishing the utility of the nourseothricin antibiotic resistance cassette as selectable marker for use in *Chaetoceros* sp. Evaluation of the genomic DNA of the stable transformants was performed by Southern analysis. Yamaguchi reported that selection and maintenance of the transformed *Chaetoceros* sp. was performed on agar plates comprising f/2 medium (as reported by Guilard, R. R., Culture of Phytoplankton for feeding marine invertebrates, In Culture of Marine Invertebrate Animals, Smith and Chantey (eds) 1975, Plenum Press, New York, pp. 26-60) with 500 ug/ml nourseothricin. Liquid propagation of *Chaetoceros* sp. transformants, as performed by Yamaguchi, was carried out in f/2 medium with 500 mg/L nourseothricin. Propagation of *Chaetoceros* sp. in additional culture medium has been reported (for example in Napolitano et al., *Journal of the World Aquaculture Society*, Vol. 21:2 (1990), pp. 122-130, and by Volkman et al., *Journal of Experimental Marine Biol-* ogy and Ecology, Vol. 128:3 (1989), pp. 219-240). Additional plasmids, promoters, 3'UTR/terminators, and selectable markers suitable for enabling heterologous gene expression in *Chaetoceros* sp. have been reported in the same report by Yamaguchi et al. Yamaguchi reported that the plasmid pTpfcp/nat, and the *Thalassiosira pseudonana* fcp promoter and 3' UTR/terminator are suitable to enable exogenous gene expression in *Chaetoceros* sp. In addition, Yamaguchi reported that the nourseothricin resistance cassette encoded on pTpfcp/nat was suitable for use as a selectable marker in *Chaetoceros* sp.

In an embodiment of the present invention, vector pTpfcp/nat, comprising the nucleotide sequence encoding the nat gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in the closely-related *Chaetoceros compressum* to reflect the codon bias inherent in nuclear genes of *Chaetoceros compressum* in accordance with Tables 69A-D. For each lipid biosynthesis pathway protein of Table 70, the codon-optimized gene sequence can individually be operably linked to the *Thalassiosira pseudonana* fcp gene promoter upstream of the protein-coding sequence and operably linked to the *Thalassiosira pseudonana* fcp gene 3'UTR/terminator at the 3' region, or downstream, of the protein-coding sequence. The transformation construct may additionally comprise homology regions to the *Chaetoceros* sp. genome for targeted genomic integration of the transformation vector. Homology regions may be selected to disrupt one or more genomic sites of endogenous lipid biosynthesis pathway genes. Stable transformation of *Chaetoceros* sp. with the transformation vector is achieved through well-known transformation including microprojectile bombardment or other known methods. Activity of the nat gene product can be used as a selectable marker to select for *Chaetoceros* sp. transformed with the transformation vector in, but not limited to, f/2 agar medium comprising nourseothricin. Growth medium suitable for *Chaetoceros* sp. lipid production include, but are not limited to, f/2 medium, and those culture media discussed by Napolitano et al. and Volkman et al. Evaluation of fatty acid profiles of *Chaetoceros* sp lipids can be assessed through standard lipid extraction and analytical methods described herein.

Example 34

Engineering *Cylindrotheca fusiformis*

Expression of recombinant genes in accordance with the present invention in *Cylindrotheca fusiformis* can be accomplished by modifying the methods and vectors taught by Poulsen and Kroger et al. as discussed herein. Briefly, Poulsen and Kroger et al., *FEBS Journal*, Vol. 272 (2005), pp. 3413-3423, reported the transformation of *Cylindrotheca fusiformis* with plasmid DNA. Using the transformation method of microprojectile bombardment, Poulsen and Kroger introduced the pCF-ble plasmid into *Cylindrotheca fusiformis*. Plasmid pCF-ble comprised a bleomycin resistance cassette, comprising sequence encoding the *Streptoalloteichus hindustanus* Bleomycin binding protein (ble), for resistance to the antibiotics zeocin and phleomycin, operably linked to the *Cylindrotheca fusiformis* fucozanthin chlorophyll a/c binding protein gene (fcpA, GenBank Accession No. AY125580) promoter upstream of the ble protein-coding region and operably linked to the *Cylindrotheca fusiformis* fcpA gene 3'UTR/terminator at the 3' region (down-stream of the ble protein-coding region). Prior to transformation with pCF-ble, *Cylindrotheca fusiformis* was unable to propagate on medium comprising 1 mg/ml zeocin. Upon transformation with pCF-ble, transformants of *Cylindrotheca fusiformis* were obtained that were propagated in selective culture medium comprising 1 mg/ml zeocin. The expression of the ble gene product in *Cylindrotheca fusiformis* enabled propagation in the presence of 1 mg/ml zeocin, thereby establishing the utility of the bleomycin antibiotic resistance cassette as selectable marker for use in *Cylindrotheca fusiformis*. Poulsen and Kroger reported that selection and maintenance of the transformed *Cylindrotheca fusiformis* was performed on agar plates comprising artificial seawater medium with 1 mg/ml zeocin. Poulsen and Kroger reported liquid propagation of *Cylindrotheca fusiformis* transformants in artificial seawater medium with 1 mg/ml zeocin. Propagation of *Cylindrotheca fusiformis* in additional culture medium has been discussed (for example in Liang et al., *Journal of Applied Phycology*, Vol. 17:1 (2005), pp. 61-65, and by Orcutt and Patterson, *Lipids*, Vol. 9:12 (1974), pp. 1000-1003). Additional plasmids, promoters, and 3'UTR/terminators for enabling heterologous gene expression in *Chaetoceros* sp. have been reported in the same report by Poulsen and Kroger. Poulsen and Kroger reported that the plasmid pCF-ble and the *Cylindrotheca fusiformis* fcp promoter and 3' UTR/terminator are suitable to enable exogenous gene expression in *Cylindrotheca fusiformis*. In addition, Poulsen and Kroger reported that the bleomycin resistance cassette encoded on pCF-ble was suitable for use as a selectable marker in *Cylindrotheca fusiformis*.

In an embodiment of the present invention, vector pCF-ble, comprising the nucleotide sequence encoding the ble gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Cylindrotheca fusiformis* to reflect the codon bias inherent in nuclear genes of *Cylindrotheca fusiformis* in accordance with Tables 69A-D. For each lipid biosynthesis pathway protein of Table 70, the codon-optimized gene sequence can individually be operably linked to the *Cylindrotheca fusiformis* fcp gene promoter upstream of the protein-coding sequence and operably linked to the *Cylindrotheca fusiformis* fcp gene 3'UTR/terminator at the 3' region, or downstream, of the protein-coding sequence. The transformation construct may additionally comprise homology regions to the *Cylindrotheca fusiformis* genome for targeted genomic integration of the transformation vector. Homology regions may be selected to disrupt one or more genomic sites of endogenous lipid biosynthesis pathway genes. Stable transformation of *Cylindrotheca fusiformis* with the transformation vector is achieved through well-known transformation techniques including microprojectile bombardment or other known methods. Activity of the ble gene product can be used as a selectable marker to select for *Cylindrotheca fusiformis* transformed with the transformation vector in, but not limited to, artificial seawater agar medium comprising zeocin. Growth media suitable for *Cylindrotheca fusiformis* lipid production include, but are not limited to, artificial seawater and those media reported by Liang et al. and Orcutt and Patterson. Evaluation of fatty acid profiles of *Cylindrotheca fusiformis* lipids can be assessed through standard lipid extraction and analytical methods described herein.

Example 35

Engineering *Amphidinium* sp.

Expression of recombinant genes in accordance with the present invention in *Amphidinium* sp. can be accomplished by modifying the methods and vectors taught by ten Lohuis and Miller et al. as discussed herein. Briefly, ten Lohuis and Miller et al., *The Plant Journal*, Vol. 13:3 (1998), pp. 427-435, reported the stable transformation of *Amphidinium* sp. with plasmid DNA. Using the transformation technique of agitation in the presence of silicon carbide whiskers, ten Lohuis introduced the plasmid pMT NPT/GUS into *Amphidinium* sp. pMT NPT/GUS comprised a neomycin resistance cassette, comprising sequence encoding the neomycin phosphotransferase II (nptII) gene product (GenBank Accession No. AAL92039) operably linked to the *Agrobacterium tumefaciens* nopaline synthase (nos) gene promoter upstream, or 5' of the nptII protein-coding region and operably linked to the 3' UTR/terminator of the nos gene at the 3' region (downstream of the nptII protein-coding region). The nptII gene product confers resistance to the antibiotic G418. The pMT NPT/GUS plasmid further comprised sequence encoding a beta-glucuronidase (GUS) reporter gene product operably-linked to a CaMV 35S promoter and further operably linked to the CaMV 35S 3' UTR/terminator. Prior to transformation with pMT NPT/GUS, *Amphidinium* sp. was unable to be propagated on medium comprising 3 mg/ml G418. Upon transformation with pMT NPT/GUS, transformants of *Amphidinium* sp. were obtained that were propagated in selective culture medium comprising 3 mg/ml G418. The expression of the nptII gene product in *Amphidinium* sp. enabled propagation in the presence of 3 mg/ml G418, thereby establishing the utility of the neomycin antibiotic resistance cassette as selectable marker for use in *Amphidinium* sp. Detectable activity of the GUS reporter gene indicated that CaMV 35S promoter and 3'UTR are suitable for enabling gene expression in *Amphidinium* sp. Evaluation of the genomic DNA of the stable transformants was performed by Southern analysis. ten Lohuis and Miller reported liquid propagation of *Amphidinium* sp transformants in medium comprising seawater supplemented with F/2 enrichment solution (provided by the supplier Sigma) and 3 mg/ml G418 as well as selection and maintenance of *Amphidinium* sp. transformants on agar medium comprising seawater supplemented with F/2 enrichment solution and 3 mg/ml G418. Propagation of *Amphidinium* sp. in additional culture medium has been reported (for example in Mansour et al., *Journal of Applied Phycology*, Vol. 17:4 (2005) pp. 287-v300). An additional plasmid, comprising additional promoters, 3'UTR/terminators, and a selectable marker for enabling heterologous gene expression in *Amphidinium* sp. have been reported in the same report by ten Lohuis and Miller. ten Lohuis and Miller reported that the plasmid pMT NPT/GUS and the promoter and 3' UTR/terminator of the nos and CaMV 35S genes are suitable to enable exogenous gene expression in *Amphidinium* sp. In addition, ten Lohuis and Miller reported that the neomycin resistance cassette encoded on pMT NPT/GUS was suitable for use as a selectable marker in *Amphidinium* sp.

In an embodiment of the present invention, vector pMT NPT/GUS, comprising the nucleotide sequence encoding the nptII gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Amphidinium* sp. to reflect the codon bias inherent in nuclear genes of the closely-related species, *Amphidinium carterae* in accordance with Tables 69A-D. For each lipid biosynthesis pathway protein of Table 70, the codon-optimized gene sequence can individually be operably linked to the *Agrobacterium tumefaciens* nopaline synthase (nos) gene promoter upstream of the protein-coding sequence and operably linked to the nos 3'UTR/terminator at the 3' region, or downstream, of the protein-coding sequence. The transformation construct may additionally comprise homology regions to the *Amphidinium* sp. genome for targeted genomic integration of the transformation vector. Homology regions may be selected to disrupt one or more genomic sites of endogenous lipid biosynthesis pathway genes. Stable transformation of *Amphidinium* sp. with the transformation vector is achieved through well-known transformation techniques including silicon fibre-mediated microinjection or other known methods. Activity of the nptII gene product can be used as a selectable marker to select for *Amphidinium* sp. transformed with the transformation vector in, but not limited to, seawater agar medium comprising G418. Growth media suitable for *Amphidinium* sp. lipid production include, but are not limited to, artificial seawater and those media reported by Mansour et al. and ten Lohuis and Miller. Evaluation of fatty acid profiles of *Amphidinium* sp. lipids can be assessed through standard lipid extraction and analytical methods described herein.

Example 36

Engineering *Symbiodinium microadriacticum*

Expression of recombinant genes in accordance with the present invention in *Symbiodinium microadriacticum* can be accomplished by modifying the methods and vectors taught by ten Lohuis and Miller et al. as discussed herein. Briefly, ten Lohuis and Miller et al., *The Plant Journal*, Vol. 13:3 (1998), pp. 427-435, reported the stable transformation of *Symbiodinium microadriacticum* with plasmid DNA. Using the transformation technique of silicon fibre-mediated microinjection, ten Lohuis introduced the plasmid pMT NPT/GUS into *Symbiodinium microadriacticum*. pMT NPT/GUS comprised a neomycin resistance cassette, comprising sequence encoding the neomycin phosphotransferase II (nptII) gene product (GenBank Accession No. AAL92039) operably linked to the *Agrobacterium tumefaciens* nopaline synthase (nos) gene promoter upstream, or 5' of the nptII protein-coding region and operably linked to the 3' UTR/terminator of the nos gene at the 3' region (down-stream of the nptII protein-coding region). The nptII gene product confers resistance to the antibiotic G418. The pMT NPT/GUS plasmid further comprised sequence encoding a beta-glucuronidase (GUS) reporter gene product operably-linked to a CaMV 35S promoter and further operably linked to the CaMV 35S 3' UTR/terminator. Prior to transformation with pMT NPT/GUS, *Symbiodinium microadriacticum* was unable to be propagated on medium comprising 3 mg/ml G418. Upon transformation with pMT NPT/GUS, transformants of *Symbiodinium microadriacticum* were obtained that were propagated in selective culture medium comprising 3 mg/ml G418. The expression of the nptII gene product in *Symbiodinium microadriacticum* enabled propagation in the presence of 3 mg/ml G418, thereby establishing the utility of the neomycin antibiotic resistance cassette as selectable marker for use in *Symbiodinium microadriacticum*. Detectable activity of the GUS reporter gene indicated that CaMV 35S promoter and 3'UTR are suitable for enabling gene expression in *Symbiodinium microadriacticum*. Evaluation of the genomic DNA of the stable transformants was performed by Southern analysis. ten Lohuis and Miller reported liquid propagation of *Symbiodinium microadriacticum* transformants in medium comprising seawater supplemented with F/2 enrichment solution (provided by the supplier Sigma) and 3 mg/ml G418 as well as selection and maintenance of *Symbiodinium microadriacticum* transformants on agar medium comprising seawater supplemented with F/2 enrichment solution and 3 mg/ml G418. Propagation of *Symbiodinium microadriacticum* in additional culture medium has been discussed (for example in Iglesias-Prieto et al., *Proceedings of the National Academy of Sciences*, Vol. 89:21 (1992) pp. 10302-10305). An additional plasmid, comprising additional promoters, 3'UTR/terminators, and a selectable marker for enabling heterologous gene expression in *Symbiodinium microadriacticum* have been discussed in the same report by ten Lohuis and Miller. ten Lohuis and Miller reported that the plasmid pMT NPT/GUS and the promoter and 3' UTR/terminator of the nos and CaMV 35S genes are suitable to enable exogenous gene expression in *Symbiodinium microadriacticum*. In addition, ten Lohuis and Miller reported that the neomycin resistance cassette encoded on pMT NPT/GUS was suitable for use as a selectable marker in *Symbiodinium microadriacticum*.

In an embodiment of the present invention, vector pMT NPT/GUS, comprising the nucleotide sequence encoding the nptII gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Symbiodinium microadriacticum*. to reflect the codon bias inherent in nuclear genes of *Symbiodinium microadriacticum* in accordance with Tables 69A-D. For each lipid biosynthesis pathway protein of Table 70, the codon-optimized gene sequence can individually be operably linked to the *Agrobacterium tumefaciens* nopaline synthase (nos) gene promoter upstream of the protein-coding sequence and operably linked to the nos 3' UTR/terminator at the 3' region, or downstream, of the protein-coding sequence. The transformation construct may additionally comprise homology regions to the *Symbiodinium microadriacticum* genome for targeted genomic integration of the transformation vector. Homology regions may be selected to disrupt one or more genomic sites of endogenous lipid biosynthesis pathway genes. Stable transformation of *Symbiodinium microadriacticum* with the transformation vector is achieved through well-known transformation techniques including silicon fibre-mediated microinjection or other known methods. Activity of the nptII gene product can be used as a selectable marker to select for *Symbiodinium microadriacticum* transformed with the transformation vector in, but not limited to, seawater agar medium comprising G418. Growth media suitable for *Symbiodinium microadriacticum* lipid production include, but are not limited to, artificial seawater and those media reported by Iglesias-Prieto et al. and ten Lohuis and Miller. Evaluation of fatty acid profiles of *Symbiodinium microadriacticum* lipids can be assessed through standard lipid extraction and analytical methods described herein.

Example 37

Engineering *Nannochloropsis* sp.

Expression of recombinant genes in accordance with the present invention in *Nannochloropsis* sp. W2J3B can be accomplished by modifying the methods and vectors taught by Kilian et al. as discussed herein. Briefly, Kilian et al., *Proceedings of the National Academy of Sciences*, Vol. 108: 52 (2011) pp. 21265-21269, reported the stable nuclear transformation of *Nannochloropsis* with a transformation construct. Using the transformation method of electroporation, Kilian introduced the transformation construct C2 into *Nannochloropsis* sp. W2J3B. The C2 transformation construct comprised a bleomycin resistance cassette, comprising the coding sequence for the *Streptoalloteichus hindustanus* Bleomycin binding protein (ble), for resistance to the antibiotics phleomycin and zeocin, operably linked to and the promoter of the *Nannochloropsis* sp. W2J3B violaxanthin/chlorophyll a-binding protein gene VCP2 upstream of the ble protein-coding region and operably linked to the 3'UTR/terminator of the *Nannochloropsis* sp. W2J3B violaxanthin/chlorophyll a-binding gene VCP1 downstream of the ble protein-coding region. Prior to transformation with C2, *Nannochloropsis* sp. W2J3B was unable to propagate on medium comprising 2 ug/ml zeocin. Upon transformation with C2, transformants of *Nannochloropsis* sp. W2J3B were obtained that were propagated in selective culture medium comprising 2 ug/ml zeocin. The expression of the ble gene product in *Nannochloropsis* sp. W2J3B enabled propagation in the presence of 2 ug/ml zeocin, thereby establishing the utility of the bleomycin antibiotic resistance cassette as selectable marker for use in *Nannochloropsis*. Evaluation of the genomic DNA of the stable transformants was performed by PCR. Kilian reported liquid propagation of *Nannochloropsis* sp. W2J3B transformants in F/2 medium (reported by Guilard and Ryther, *Canadian Journal of Microbiology*, Vol. 8 (1962), pp. 229-239) comprising fivefold levels of trace metals, vitamins, and phosphate solution, and further comprising 2 ug/ml zeocin. Kilian also reported selection and maintenance of *Nannochloropsis* sp. W2J3B transformants on agar F/2 medium comprising artificial seawater 2 mg/ml zeocin. Propagation of *Nannochloropsis* in additional culture medium has been discussed (for example in Chiu et al., *Bioresour Technol.*, Vol. 100:2 (2009), pp. 833-838 and Pal et al., *Applied Microbiology and Biotechnology*, Vol. 90:4 (2011), pp. 1429-1441). Additional transformation constructs, comprising additional promoters and 3'UTR/terminators for enabling heterologous gene expression in *Nannochloropsis* sp. W2J3B and selectable markers for selection of transformants have been described in the same report by Kilian. Kilian reported that the transformation construct C2 and the promoter of the *Nannochloropsis* sp. W2J3B violaxanthin/chlorophyll a-binding protein gene VCP2 and 3' UTR/terminator of the *Nannochloropsis* sp. W2J3B violaxanthin/chlorophyll a-binding protein gene VCP1 are suitable to enable exogenous gene expression in *Nannochloropsis* sp. W2J3B. In addition, Kilian reported that the bleomycin resistance cassette encoded on C2 was suitable for use as a selectable marker in *Nannochloropsis* sp. W2J3B.

In an embodiment of the present invention, transformation construct C2, comprising the nucleotide sequence encoding the ble gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Nannochloropsis* sp. W2J3B to reflect the codon bias inherent in nuclear genes of *Nannochloropsis* sp. in accordance with Tables 69A-D. For each lipid biosynthesis pathway protein of Table 70, the codon-optimized gene sequence can individually be operably linked to the *Nannochloropsis* sp. W2J3B VCP2 gene promoter upstream of the protein-coding sequence and operably linked to the *Nannochloropsis* sp. W2J3B VCP1 gene 3'UTR/terminator at the 3' region, or downstream, of the protein-coding sequence. The transformation construct may additionally comprise homology regions to the *Nannochloropsis* sp. W2J3B genome for targeted genomic integration of the transformation vector. Homology regions may be selected to disrupt one or more genomic sites of endogenous lipid biosynthesis pathway genes. Stable transformation of *Nannochloropsis* sp. W2J3B with the transformation vector is achieved through well-known transformation techniques including electroporation or other known methods. Activity of the ble gene product can be used as a selectable marker to select for *Nannochloropsis* sp. W2J3B transformed with the transformation vector in, but not limited to, F/2 medium comprising zeocin. Growth media suitable for *Nannochloropsis* sp. W2J3B lipid production include, but are not limited to, F/2 medium and those media reported by Chiu et al. and Pal et al. Evaluation of fatty acid profiles of *Nannochloropsis* sp. W2J3B lipids can be assessed through standard lipid extraction and analytical methods described herein.

Example 38

Engineering *Cyclotella cryptica*

Expression of recombinant genes in accordance with the present invention in *Cyclotella cryptica* can be accomplished by modifying the methods and vectors taught by Dunahay et al. as discussed herein. Briefly, Dunahay et al., *Journal of Phycology*, Vol. 31 (1995), pp. 1004-1012, reported the stable transformation of *Cyclotella cryptica* with plasmid DNA. Using the transformation method of microprojectile bombardment, Dunahay introduced the plasmid pACCNPT5.1 into *Cyclotella cryptica*. Plasmid pACCNPT5.1 comprised a neomycin resistance cassette, comprising the coding sequence of the neomycin phosphotransferase II (nptII) gene product operably linked to the promoter of the *Cyclotella cryptica* acetyl-CoA carboxylase (ACCase) gene (GenBank Accession No. L20784) upstream of the nptII coding-region and operably linked to the 3'UTR/terminator of the *Cyclotella cryptica* ACCase gene at the 3' region (downstream of the nptII coding-region). The nptII gene product confers resistance to the antibiotic G418. Prior to transformation with pACCNPT5.1, *Cyclotella cryptica* was unable to propagate on 50% artificial seawater medium comprising 100 ug/ml G418. Upon transformation with pACCNPT5.1, transformants of *Cyclotella cryptica* were obtained that were propagated in selective 50% artificial seawater medium comprising 100 ug/ml G418. The expression of the nptII gene product in *Cyclotella cryptica* enabled propagation in the presence of 100 ug/ml G418, thereby establishing the utility of the neomycin antibiotic resistance cassette as selectable marker for use in *Cyclotella cryptica*. Evaluation of the genomic DNA of the stable transformants was performed by Southern analysis. Dunahay reported liquid propagation of *Cyclotella cryptica* in artificial seawater medium (ASW, as discussed by Brown, L., *Phycologia*, Vol. 21 (1982), pp. 408-410) supplemented with 1.07 mM sodium silicate and with 100 ug/ml G418. Dunahay also reported selection and maintenance of *Cyclotella cryptica* transformants on agar plates comprising ASW medium with 100 ug/ml G418. Propagation of *Cyclotella cryptica* in additional culture medium has been discussed (for example in Sriharan et al., *Applied Biochemistry and Biotechnology*, Vol. 28-29:1 (1991), pp. 317-326 and Pahl et al., *Journal of Bioscience and Bioengineering*, Vol. 109:3 (2010), pp. 235-239). Dunahay reported that the plasmid pACCNPT5.1 and the promoter of the *Cyclotella cryptica* acetyl-CoA carboxylase (ACCase) gene are suitable to enable exogenous gene expression in *Cyclotella cryptica*. In addition, Dunahay reported that the neomycin resistance cassette encoded on pACCNPT5.1 was suitable for use as a selectable marker in *Cyclotella cryptica*.

In an embodiment of the present invention, vector pACCNPT5.1, comprising the nucleotide sequence encoding the nptII gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Cyclotella cryptica* to reflect the codon bias inherent in nuclear genes of *Cyclotella cryptica* in accordance with Tables 69A-D. For each lipid biosynthesis pathway protein of Table 70, the codon-optimized gene sequence can individually be operably linked to the *Cyclotella cryptica* ACCase promoter upstream of the protein-coding sequence and operably linked to the *Cyclotella cryptica* ACCase 3'UTR/terminator at the 3' region, or downstream, of the protein-coding sequence. The transformation construct may additionally comprise homology regions to the *Cyclotella cryptica* genome for targeted genomic integration of the transformation vector. Homology regions may be selected to disrupt one or more genomic sites of endogenous lipid biosynthesis pathway genes. Stable transformation of *Cyclotella cryptica* with the transformation vector is achieved through well-known transformation techniques including microprojectile bombardment or other known methods. Activity of the nptII gene product can be used as a marker to select for *Cyclotella cryptica* transformed with the transformation vector in, but not limited to, agar ASW medium comprising G418. Growth media suitable for *Cyclotella cryptica* lipid production include, but are not limited to, ASW medium and those media reported by Sriharan et al., 1991 and Pahl et al. Evaluation of fatty acid profiles of *Cyclotella cryptica* lipids can be assessed through standard lipid extraction and analytical methods described herein.

Example 39

Engineering *Navicula saprophila*

Expression of recombinant genes in accordance with the present invention in *Navicula saprophila* can be accomplished by modifying the methods and vectors taught by Dunahay et al. as discussed herein. Briefly, Dunahay et al., *Journal of Phycology*, Vol. 31 (1995), pp. 1004-1012, reported the stable transformation of *Navicula saprophila* with plasmid DNA. Using the transformation method of microprojectile bombardment, Dunahay introduced the plasmid pACCNPT5.1 into *Navicula saprophila*. Plasmid pACCNPT5.1 comprised a neomycin resistance cassette, comprising the coding sequence of the neomycin phosphotransferase II (nptII) gene product operably linked to the promoter of the *Cyclotella cryptica* acetyl-CoA carboxylase (ACCase) gene (GenBank Accession No. L20784) upstream of the nptII coding-region and operably linked to the 3'UTR/terminator of the *Cyclotella cryptica* ACCase gene at the 3' region (downstream of the nptII coding-region). The nptII gene product confers resistance to the antibiotic G418. Prior to transformation with pACCNPT5.1, *Navicula saprophila* was unable to propagate on artificial seawater medium comprising 100 ug/ml G418. Upon transformation with pACCNPT5.1, transformants of *Navicula saprophila* were obtained that were propagated in selective artificial seawater medium comprising 100 ug/ml G418. The expression of the nptII gene product in *Navicula saprophila* enabled propagation in the presence of G418, thereby establishing the utility of the neomycin antibiotic resistance cassette as selectable marker for use in *Navicula saprophila*. Evaluation of the genomic DNA of the stable transformants was performed by Southern analysis. Dunahay reported liquid propagation of *Navicula saprophila* in artificial seawater medium (ASW, as discussed by Brown, L., *Phycologia*, Vol. 21 (1982), pp. 408-410) supplemented with 1.07 mM sodium silicate and with 100 ug/ml G418. Dunahay also reported selection and maintenance of *Navicula saprophila* transformants on agar plates comprising ASW medium with 100 ug/ml G418. Propagation of *Navicula saprophila* in additional culture medium has been discussed (for example in Tadros and Johansen, *Journal of Phycology*, Vol. 24:4 (1988), pp. 445-452 and Sriharan et al., *Applied Biochemistry and Biotechnology*, Vol. 20-21:1 (1989), pp. 281-291). Dunahay reported that the plasmid pACCNPT5.1 and the promoter of the *Cyclotella cryptica* acetyl-CoA carboxylase (ACCase) gene are suitable to enable exogenous gene expression in *Navicula saprophila*. In addition, Dunahay reported that the neomycin resistance cassette encoded on pACCNPT5.1 was suitable for use as a selectable marker in *Navicula saprophila*.

In an embodiment of the present invention, vector pACCNPT5.1, comprising the nucleotide sequence encoding the nptII gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Navicula saprophila* to reflect the codon bias inherent in nuclear genes of the closely-related *Navicula pelliculosa* in accordance with Tables 69A-D. For each lipid biosynthesis pathway protein of Table 70, the codon-optimized gene sequence can individually be operably linked to the *Cyclotella cryptica* ACCase gene promoter upstream of the protein-coding sequence and operably linked to the *Cyclotella cryptica* ACCase gene 3'UTR/terminator at the 3' region, or downstream, of the protein-coding sequence. The transformation construct may additionally comprise homology regions to the *Navicula saprophila* genome for targeted genomic integration of the transformation vector. Homology regions may be selected to disrupt one or more genomic sites of endogenous lipid biosynthesis pathway genes. Stable transformation of *Navicula saprophila* with the transformation vector is achieved through well-known transformation techniques including microprojectile bombardment or other known methods. Activity of the nptII gene product can be used as a selectable marker to select for *Navicula saprophila* transformed with the transformation vector in, but not limited to, agar ASW medium comprising G418. Growth media suitable for *Navicula saprophila* lipid production include, but are not limited to, ASW medium and those media reported by Sriharan et al. 1989 and Tadros and Johansen. Evaluation of fatty acid profiles of *Navicula saprophila* lipids can be assessed through standard lipid extraction and analytical methods described herein.

Example 40

Engineering *Thalassiosira pseudonana*

Expression of recombinant genes in accordance with the present invention in *Thalassiosira pseudonana* can be accomplished by modifying the methods and vectors taught by Poulsen et al. as discussed herein. Briefly, Poulsen et al., *Journal of Phycology*, Vol. 42 (2006), pp. 1059-1065, reported the stable transformation of *Thalassiosira pseudonana* with plasmid DNA. Using the transformation method of microprojectile bombardment, Poulsen introduced the plasmid pTpfcp/nat in to *Thalassiosira pseudonana*. pTpfcp/nat comprised a nourseothricin resistance cassette, comprising sequence encoding the nourseothricin acetyltransferase (nat) gene product (GenBank Accession No. AAC60439) operably linked to the *Thalassiosira pseudonana* fucoxanthin chlorophyll a/c binding protein gene (fcp) promoter upstream of the nat protein-coding region and operably linked to the *Thalassiosira pseudonana* fcp gene 3' UTR/terminator at the 3' region (downstream of the nat protein coding-sequence). The nat gene product confers resistance to the antibiotic nourseothricin. Prior to transformation with pTpfcp/nat, *Thalassiosira pseudonana* was unable to propagate on medium comprising 10 ug/ml nourseothricin. Upon transformation with pTpfcp/nat, transformants of *Thalassiosira pseudonana* were obtained that were propagated in selective culture medium comprising 100 ug/ml nourseothricin. The expression of the nat gene product in *Thalassiosira pseudonana* enabled propagation in the presence of 100 ug/ml nourseothricin, thereby establishing the utility of the nourseothricin antibiotic resistance cassette as selectable marker for use in *Thalassiosira pseudonana*. Evaluation of the genomic DNA of the stable transformants was performed by Southern analysis. Poulsen reported that selection and maintenance of the transformed *Thalassiosira pseudonana* was performed in liquid culture comprising modified ESAW medium (as discussed by Harrison et al., *Journal of Phycology*, Vol. 16 (1980), pp. 28-35) with 100 ug/ml nourseothricin. Propagation of *Thalassiosira pseudonana* in additional culture medium has been discussed (for example in Volkman et al., *Journal of Experimental Marine Biology and Ecology*, Vol. 128:3 (1989), pp. 219-240). An additional plasmid, comprising additional selectable markers suitable for use in *Thalassiosira pseudonana* has been discussed in the same report by Poulsen. Poulsen reported that the plasmid pTpfcp/nat, and the *Thalassiosira pseudonana* fcp promoter and 3' UTR/terminator are suitable to enable exogenous gene expression in *Thalassiosira pseudonana*. In addition, Poulsen reported that the nourseothricin resistance cassette encoded on pTpfcp/nat was suitable for use as a selectable marker in *Thalassiosira pseudonana*.

In an embodiment of the present invention, vector pTpfcp/nat, comprising the nucleotide sequence encoding the nat gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Thalassiosira pseudonana* to reflect the codon bias inherent in nuclear genes of *Thalassiosira pseudonana* in accordance with Tables 69A-D. For each lipid biosynthesis pathway protein of Table 70, the codon-optimized gene sequence can individually be operably linked to the *Thalassiosira pseudonana* fcp gene promoter upstream of the protein-coding sequence and operably linked to the *Thalassiosira pseudonana* fcp gene 3'UTR/terminator at the 3' region, or downstream, of the protein-coding sequence. The transformation construct may additionally comprise homology regions to the *Thalassiosira pseudonana* genome for targeted genomic integration of the transformation vector. Homology regions may be selected to disrupt one or more genomic sites of endogenous lipid biosynthesis pathway genes. One skilled in the art can identify such homology regions within the sequence of the *Thalassiosira pseudonana* genome (referenced in the publication by Armbrust et al., *Science*, Vol. 306: 5693 (2004): pp. 79-86). Stable transformation of *Thalassiosira pseudonana* with the transformation vector is achieved through well-known transformation techniques including microprojectile bombardment or other known methods. Activity of the nat gene product can be used as a marker to select for *Thalassiosira pseudonana* transformed with the transformation vector in but not limited to, ESAW agar medium comprising nourseothricin. Growth media suitable for *Thalassiosira pseudonana* lipid production include, but are not limited to, ESAW medium, and those culture media discussed by Volkman et al. and Harrison et al. Evaluation of fatty acid profiles of *Thalassiosira pseudonana* lipids can be assessed through standard lipid extraction and analytical methods described herein.

Example 41

Engineering *Chlamydomonas reinhardtii*

Expression of recombinant genes in accordance with the present invention in *Chlamydomonas reinhardtii* can be accomplished by modifying the methods and vectors taught by Cerutti et al. as discussed herein. Briefly, Cerutti et al., *Genetics*, Vol. 145:1 (1997), pp. 97-110, reported the stable nuclear transformation of *Chlamydomonas reinhardtii* with a transformation vector. Using the transformation method of microprojectile bombardment, Cerutti introduced transformation construct P[1030] into *Chlamydomonas reinhardtii*. Construct P[1030] comprised a spectinomycin resistance cassette, comprising sequence encoding the aminoglucoside 3"-adenyltransferase (aadA) gene product operably linked to the *Chlamydomonas reinhardtii* ribulose-1,5-bisphosphate carboxylase/oxygenase small subunit gene (RbcS2, GenBank Accession No. X04472) promoter upstream of the aadA protein-coding region and operably linked to the *Chlamydomonas reinhardtii* RbcS2 gene 3' UTR/terminator at the 3' region (downstream of the aadA protein coding-sequence). The aadA gene product confers resistance to the antibiotic spectinomycin. Prior to transformation with P[1030], *Chlamydomonas reinhardtii* was unable to propagate on medium comprising 90 ug/ml spectinomycin. Upon transformation with P[1030], transformants of *Chlamydomonas reinhardtii* were obtained that were propagated in selective culture medium comprising 90 ug/ml spectinomycin, thereby establishing the utility of the spectinomycin antibiotic resistance cassette as a selectable marker for use in *Chlamydomonas reinhardtii*. Evaluation of the genomic DNA of the stable transformants was performed by Southern analysis. Cerutti reported that selection and maintenance of the transformed *Chlamydomonas reinhardtii* was performed on agar plates comprising Tris-acetate-phosphate medium (TAP, as described by Harris, The *Chlamydomonas Sourcebook*, Academic Press, San Diego, 1989) with 90 ug/ml spectinomycin. Cerutti additionally reported propagation of *Chlamydomonas reinhardtii* in TAP liquid culture with 90 ug/ml spectinomycin. Propagation of *Chlamydomonas reinhardtii* in alternative culture medium has been discussed (for example in Dent et al., *African Journal of Microbiology Research*, Vol. 5:3 (2011), pp. 260-270 and Yantao et al., *Biotechnology and Bioengineering*, Vol. 107:2 (2010), pp. 258-268). Additional constructs, comprising additional selectable markers suitable for use in *Chlamydomonas reinhardtii* as well as numerous regulatory sequences, including protomers and 3' UTRs suitable for promoting heterologous gene expression in *Chlamydomonas reinhardtii* are known in the art and have been discussed (for a review, see Radakovits et al., *Eurkaryotic Cell*, Vol. 9:4 (2010), pp. 486-501). Cerutti reported that the transformation vector P[1030] and the *Chlamydomonas reinhardtii* promoter and 3' UTR/terminator are suitable to enable exogenous gene expression in *Chlamydomonas reinhardtii*. In addition, Cerutti reported that the spectinomycin resistance cassette encoded on P[1030] was suitable for use as a selectable marker in *Chlamydomonas reinhardtii*.

In an embodiment of the present invention, vector P[1030], comprising the nucleotide sequence encoding the aadA gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Chlamydomonas reinhardtii* to reflect the codon bias inherent in nuclear genes of *Chlamydomonas reinhardtii* in accordance with Tables 69A-D. For each lipid biosynthesis pathway protein of Table 70, the codon-optimized gene sequence can individually be operably linked to the *Chlamydomonas reinhardtii* RbcS2 promoter upstream of the protein-coding sequence and operably linked to the *Chlamydomonas reinhardtii* RbcS2 3'UTR/terminator at the 3' region, or downstream, of the protein-coding sequence. The transformation construct may additionally comprise homology regions to the *Chlamydomonas reinhardtii* genome for targeted genomic integration of the transformation vector. Homology regions may be selected to disrupt one or more genomic site of an endogenous lipid biosynthesis pathway gene. One skilled in the art can identify such homology regions within the sequence of the *Chlamydomonas reinhardtii* genome (referenced in the publication by Merchant et al., *Science*, Vol. 318:5848 (2007), pp. 245-250). Stable transformation of *Chlamydomonas reinhardtii* with the transformation vector is achieved through well-known transformation techniques including microprojectile bombardment or other known methods. Activity of the aadA gene product can be used as a marker to select for *Chlamydomonas reinhardtii* transformed with the transformation vector on, but not limited to, TAP agar medium comprising spectinomycin. Growth media suitable for *Chlamydomonas reinhardtii* lipid production include, but are not limited to, ESAW medium, and those culture media discussed by Yantao et al. and Dent et al. Evaluation of fatty acid profiles of *Chlamydomonas reinhardtii* lipids can be assessed through standard lipid extraction and analytical methods described herein.

Example 42

Engineering *Yarrowia lipolytica*

Expression of recombinant genes in accordance with the present invention in *Yarrowia lipolytica* can be accomplished by modifying the methods and vectors taught by Fickers et al. as discussed herein. Briefly, Fickers et al., *Journal of Microbiological Methods*, Vol. 55 (2003), pp. 727-737, reported the stable nuclear transformation of *Yarrowia lipolytica* with plasmid DNA. Using a lithium acetate transformation method, Fickers introduced the plasmid JMP123 into *Yarrowia lipolytica*. Plasmid JMP123 comprised a hygromycin B resistance cassette, comprising sequence encoding the hygromycin B phosphotransferase gene product (hph), operably-linked to the *Yarrowia lipolytica* LIP2 gene promoter (GenBank Accession No. AJ012632) upstream of the hph protein-coding region and operably linked to the *Yarrowia lipolytica* LIP2 gene 3'UTR/terminator downstream of the hph protein-coding region. Prior to transformation with JMP123, *Yarrowia lipolytica* were unable to propagate on medium comprising 100 ug/ml hygromycin. Upon transformation with JMP123, transformed *Yarrowia lipolytica* were obtained that were able to propagate on medium comprising 100 ug/ml hygromycin, thereby establishing the hygromycin B antibiotic resistance cassette as a selectable marker for use in *Yarrowia lipolytica*. The nucleotide sequence provided on JMP123 of the promoter and 3'UTR/terminator of the *Yarrowia lipolytica* LIP2 gene served as donor sequences for homologous recombination of the hph coding sequence into the LIP2 locus. Evaluation of the genomic DNA of the stable transformants was performed by Southern. Fickers reported that selection and maintenance of the transformed *Yarrowia lipolytica* was performed on agar plates comprising standard YPD medium (Yeast Extract Peptone Dextrose) with 100 ug/ml hygromycin. Liquid culturing of transformed *Yarrowia lipolytica* was performed in YPD medium with hygromycin. Other media and techniques used for culturing *Yarrowia lipolytica* have been reported and numerous other plasmids, promoters, 3' UTRs, and selectable markers for use in *Yarrowia lipolytica* have been reported (for example see Pignede et al., *Applied and Environmental Biology*, Vol. 66:8 (2000), pp. 3283-3289, Chuang et al., *New Biotechnology*, Vol. 27:4 (2010), pp. 277-282, and Barth and Gaillardin, (1996), In: K, W. (Ed.), Nonconventional Yeasts in Biotecnology. Sprinter-Verlag, Berlin-Heidelber, pp. 313-388). Fickers reported that the transformation vector JMP123 and the *Yarrowia lipolytica* LIP2 gene promoter and 3' UTR/terminator are suitable to enable heterologous gene expression in *Yarrowia lipolytica*. In addition, Fickers reported that the hygromycin resistance cassette encoded on JMP123 was suitable for use as a selectable marker in *Yarrowia lipolytica*.

In an embodiment of the present invention, vector JMP123, comprising the nucleotide sequence encoding the hph gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Yarrowia lipolytica* to reflect the codon bias inherent in nuclear genes of *Yarrowia lipolytica* in accordance with Tables 69A-D. For each lipid biosynthesis pathway protein of Table 70, the codon-optimized gene sequence can individually be operably linked to the *Yarrowia lipolytica* LIP2 gene promoter upstream of the protein-coding sequence and operably linked to the *Yarrowia lipolytica* LIP2 gene 3'UTR/terminator at the 3' region, or downstream, of the protein-coding sequence. The transformation construct may additionally comprise homology regions to the *Yarrowia lipolytica* genome for targeted genomic integration of the transformation vector. Homology regions may be selected to disrupt one or more genomic sites of endogenous lipid biosynthesis pathway genes. One skilled in the art can identify such homology regions within the sequence of the *Yarrowia lipolytica* genome (referenced in the publication by Dujun et al., *Nature*, Vol. 430 (2004), pp. 35-44). Stable transformation of *Yarrowia lipolytica* with the transformation vector is achieved through well-known transformation techniques including lithium acetate transformation or other known methods. Activity of the hph gene product can be used as a marker to select for *Yarrowia lipolytica* transformed with the transformation vector on, but not limited to, YPD medium comprising hygromycin. Growth media suitable for *Yarrowia lipolytica* lipid production include, but are not limited to, YPD medium, and those culture media described by Chuang et al. Evaluation of fatty acid profiles of *Yarrowia lipolytica* lipids can be assessed through standard lipid extraction and analytical methods described herein.

Example 43

Engineering *Mortierella alpine*

Expression of recombinant genes in accordance with the present invention in *Mortierella alpine* can be accomplished by modifying the methods and vectors taught by Mackenzie et al. as discussed herein. Briefly, Mackenzie et al., *Applied and Environmental Microbiology*, Vol. 66 (2000), pp. 4655-4661, reported the stable nuclear transformation of *Mortierella alpina* with plasmid DNA. Using a protoplast transformation method, MacKenzie introduced the plasmid pD4 into *Mortierella alpina*. Plasmid pD4 comprised a hygromycin B resistance cassette, comprising sequence encoding the hygromycin B phosphotransferase gene product (hpt), operably-linked to the *Mortierella alpina* histone H4.1 gene promoter (GenBank Accession No. AJ249812) upstream of the hpt protein-coding region and operably linked to the *Aspergillus nidulans* N-(5'-phosphoribosyl)anthranilate isomerase (trpC) gene 3'UTR/terminator downstream of the hpt protein-coding region. Prior to transformation with pD4, *Mortierella alpina* were unable to propagate on medium comprising 300 ug/ml hygromycin. Upon transformation with pD4, transformed *Mortierella alpina* were obtained that were propagated on medium comprising 300 ug/ml hygromycin, thereby establishing the hygromycin B antibiotic resistance cassette as a selectable marker for use in *Mortierella alpina*. Evaluation of the genomic DNA of the stable transformants was performed by Southern. Mackenzie reported that selection and maintenance of the transformed *Mortierella alpina* was performed on PDA (potato dextrose agar) medium comprising hygromycin. Liquid culturing of transformed *Mortierella alpina* by Mackenzie was performed in PDA medium or in S2GYE medium (comprising 5% glucose, 0.5% yeast extract, 0.18% $NH_4SO_4$, 0.02% $MgSO_4.7H_2O$, 0.0001% $FeCl_3$-$6H_2O$, 0.1%, trace elements, 10 mM $K_2HPO_4$—$NaH_2PO_4$), with hygromycin. Other media and techniques used for culturing *Mortierella alpina* have been reported and other plasmids, promoters, 3' UTRs, and selectable markers for use in *Mortierella alpina* have been reported (for example see Ando et al., *Applied and Environmental Biology*, Vol. 75:17 (2009) pp. 5529-35 and Lu et al., *Applied Biochemistry and Biotechnology*, Vol. 164:7 (2001), pp. 979-90). Mackenzie reported that the transformation vector pD4 and the *Mortierella alpina* histone H4.1 promoter and *A. nidulans* trpC gene 3' UTR/terminator are suitable to enable heterologous gene expression in *Mortierella alpina*. In addition, Mackenzie reported that the hygromycin resistance cassette encoded on pD4 was suitable for use as a selectable marker in *Mortierella alpina*.

In an embodiment of the present invention, vector pD4, comprising the nucleotide sequence encoding the hpt gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Mortierella alpina* to reflect the codon bias inherent in nuclear genes of *Mortierella alpina* in accordance with Tables 69A-D. For each lipid biosynthesis pathway protein of Table 70, the codon-optimized gene sequence can individually be operably linked to the *Mortierella alpina* histone H4.1 gene promoter upstream of the protein-coding sequence and operably linked to the *A. nidulans* trpC 3'UTR/terminator at the 3' region, or downstream, of the protein-coding sequence. The transformation construct may additionally comprise homology regions to the *Mortierella alpina* genome for targeted genomic integration of the transformation vector. Homology regions may be selected to disrupt one or more genomic sites of endogenous lipid biosynthesis pathway genes. One skilled in the art can identify such homology regions within the sequence of the *Mortierella alpina* genome (referenced in the publication by Wang et al., *PLOS One*, Vol. 6:12 (2011)). Stable transformation of *Mortierella alpina* with the transformation vector is achieved through well-known transformation techniques including protoplast transformation or other known methods. Activity of the hpt gene product can be used as a marker to select for *Mortierella alpina* transformed with the transformation vector on, but not limited to, PDA medium comprising hygromycin. Growth media suitable for *Mortierella alpina* lipid production include, but are not limited to, S2GYE medium, and those culture media described by Lu et al. and Ando et al. Evaluation of fatty acid profiles of *Mortierella alpina* lipids can be assessed through standard lipid extraction and analytical methods described herein.

Example 44

Engineering *Rhodococcus opacus* PD630

Expression of recombinant genes in accordance with the present invention in *Rhodococcus opacus* PD630 can be accomplished by modifying the methods and vectors taught by Kalscheuer et al. as discussed herein. Briefly, Kalscheuer et al., *Applied and Environmental Microbiology*, Vol. 52 (1999), pp. 508-515, reported the stable transformation of *Rhodococcus opacus* with plasmid DNA. Using the transformation method of electroporation, Kalscheuer introduced the plasmid pNC9501 into *Rhodococcus opacus* PD630. Plasmid pNC9501 comprised a thiostrepton resistance (thio$^r$) cassette, comprising the full nucleotide sequence of the *Streptomyces azureus* 23S rRNA A1067 methyltransferase gene, including the gene's promoter and 3' terminator sequence. Prior to transformation with pNC9501, *Rhodococcus opacus* was unable to propagate on medium comprising 1 mg/ml thiostrepton. Upon transformation of *Rhodococcus opacus* PD630 with pNC9501, transformants were obtained that propagated on culture medium comprising 1 mg/ml thiostrepton, thereby establishing the use of the thiostrepton resistance cassette as a selectable marker in *Rhodococcus opacus* PD630. A second plasmid described by Kalscheuer, pAK68, comprised the resistance thio$^r$ cassette as well as the gene sequences of the *Ralstonia eutropha* beta-ketothiolase (phaB), acetoacetyl-CoA reductase (phaA), and poly3-hydroxyalkanoic acid synthase (phaC) genes for polyhydroxyalkanoate biosynthesis, driven by the lacZ promoter. Upon pAK68 transformation of a *Rhodococcus opacus* PD630 strain deficient in polyhydroxyalkanoate biosynthesis, transformed *Rhodococcus opacus* PD630 were obtained that produced higher amounts of polyhydroxyalkanoates than the untransformed strain. Detectable activity of the introduced *Ralstonia eutropha* phaB, phaA, and phaC enzymes indicted that the regulatory elements encoded on the pAK68 plasmid were suitable for heterologous gene expression in *Rhodococcus opacus* PD630. Kalscheuer reported that selection and maintenance of the transformed *Rhodococcus opacus* PD630 was performed on standard Luria Broth (LB) medium, nutrient broth (NB), or mineral salts medium (MSM) comprising thiostrepton. Other media and techniques used for culturing *Rhodococcus opacus* PD630 have been described (for example see Kurosawa et al., *Journal of Biotechnology*, Vol. 147:3-4 (2010), pp. 212-218 and Alverez et al., *Applied Microbial and Biotechnology*, Vol. 54:2 (2000), pp. 218-223). Kalscheuer reported that the transformation vectors pNC9501 and pAK68, the promoters of the *Streptomyces azureus* 23S rRNA A1067 methyltransferase gene and lacZ gene are suitable to enable heterologous gene expression in *Rhodococcus opacus* PD630. In addition, Kalscheuer reported that the thio$^r$ cassette encoded on pNC9501 and pAK68 was suitable for use as a selectable marker in *Rhodococcus opacus* PD630.

In an embodiment of the present invention, vector pNC9501, comprising the nucleotide sequence encoding the thio$^r$ gene product for use as a selectable marker, is constructed and modified to further comprise a lipid biosynthesis pathway expression cassette sequence, thereby creating a transformation vector. The lipid biosynthesis pathway expression cassette encodes one or more lipid biosynthesis pathway proteins selected from Table 70, each protein-coding sequence codon-optimized for expression in *Rhodococcus opacus* PD630 to reflect the codon bias inherent in nuclear genes of *Rhodococcus opacus* in accordance with Tables 69A-D. For each lipid biosynthesis pathway protein of Table 70, the codon-optimized gene sequence can individually be operably linked to the lacZ gene promoter upstream of the protein-coding sequence. The transformation construct may additionally comprise homology regions to the *Rhodococcus opacus* PD630 genome for targeted genomic integration of the transformation vector. Homology regions may be selected to disrupt one or more genomic sites of endogenous lipid biosynthesis pathway genes. One skilled in the art can identify such homology regions within the sequence of the *Rhodococcus opacus* PD630 genome (referenced in the publication by Holder et al., *PLOS Genetics*, Vol. 7:9 (2011). Transformation of *Rhodococcus opacus* PD630 with the transformation vector is achieved through well-known transformation techniques including electoporation or other known methods. Activity of the *Streptomyces azureus* 23S rRNA A1067 methyltransferase gene product can be used as a marker to select for *Rhodococcus opacus* PD630 transformed with the transformation vector on, but not limited to, LB medium comprising thiostrepton. Growth media suitable *Rhodococcus opacus* PD630 lipid production include, but are not limited to those culture media discussed by Kurosawa et al. and Alvarez et al. Evaluation of fatty acid profiles of *Rhodococcus opacus* PD630 lipids can be assessed through standard lipid extraction and analytical methods described herein.

All references cited herein, including patents, patent applications, and publications, including Genbank Accession numbers, are hereby incorporated by reference in their entireties, whether previously specifically incorporated or not. The publications mentioned herein are cited for the purpose of describing and disclosing reagents, methodologies and concepts that may be used in connection with the present invention. Nothing herein is to be construed as an admission that these references are prior art in relation to the inventions described herein. In particular, the following patent applications are hereby incorporated by reference in their entireties for all purposes: PCT Application No. PCT/US2008/065563, filed Jun. 2, 2008, entitled "Production of Oil in Microorganisms", PCT Application No. PCT/US2010/31108, filed Apr. 14, 2010, entitled "Methods of Microbial Oil Extraction and Separation", and PCT Application No. PCT/US2009/066142, filed Nov. 30, 2009, entitled "Production of Tailored Oils in Heterotrophic Microorganisms".

SEQUENCE LISTING (256 sequences)

SEQ ID NO: 1 - DNA, 1187 bp, Unknown
  Chlorella species
gatcagacgggcctgacctgcgagataatcaagtgctcgtaggcaaccaactcagcagctgcttggtgttgggtctgcaggatagtgttgcagggccccaaggacagcaggggaacttacaccttgtccccgacccagttttatggagtgcattgcctcaagagcctagccggagcgctaggctacatacttgccgcaccggtatgaggggatatagtactcgcactgcgctgtctagtgagatgggcagtgctgcccataaacaactggctgctcagccatttgttggcggaccattctgggggggccagcaatgcctgactttcgggtagggtgaaaactgaacaaagactaccaaaacagaatttcttcctccttggaggtaagcgcaggccggcccgcctgcgcccacatggcgctccgaacacctccatagctgtaagggcgcaaacatggccggactgttgtcagcactctttcatggccatacaaggtcatgtcgagattagtgctgagtaagacactatcaccccatgttcgattgaagccgtgacttcatgccaacctgcccctgggcgtagcagacgtatgccatcatgaccactagccgacatgcgctgtcttttgccaccaaaacaactggtacaccgctcgaagtcgtgccgcacacctccgggagtgagtccggcgactcctccccggcgggccgcggccctacctgggtagggtcgccatacgcccacgaccaaacgacgcaggaggggattggggtagggaatcccaaccagcctaaccaagacggcacctataataataggtggggggactaacagccctatatcgcaagctttgggtgcctatcttgagaagcacgagttggagtggctgtgtacggtcgaccctaaggtgggtgtgccgcagcctgaaacaaagcgtctagcagctgcttctataatgtgtcagccgttgtgtttcagttatattgtatgctattgtttgttcgtgctagggtggcgcaggcccacctactgtggcgggccattggttggtgcttgaattgcctcaccatctaaggtctgaacgctcactcaaacgcctttgtacaactgcagaactttccttggcgctgcaactacagtgtgcaaaccagcacatagcactcccttacatcacccagcagtacaaca

SEQ ID NO: 2 - DNA, 1414 bp, Chlorella ellipsoidea
cgctgcgcaccagggccgccagctcgctgatgtcgctccaaatgcggtcccccgattttttgttcttcatcttctccaccttggtggccttcttggccagggccttcagctgcatgcgcacagaccgttgagctcctgatcagcatcctcaggaggccctttgacaagcaagcccctgtgcaagcccattcacggggtaccagtggtgctgaggtagatgggtttgaaaaggattgctcggtcgattgctgctcatggaattggcatgtgcatgcatgttcacaatatgccaccaggctttggagcaagagagcatgaatgccttcaggcaggttgaaagttcctgggggtgaagaggcagggccgaggattggaggaggaaagcatcaagtcgtcgctcatgctcatgttttcagtcagagtttgccaagctcacaggagcagagacaagactggctgctcaggtgttgcatcgtgtgtgtggtgggggggggggggttaatacggtacgaaatgcacttggaattcccacctcatgccagcggacccacatgcttgaattcgaggcctgtggggtgagaaatgctcactctgccctcgttgctgaggtacttcaggccgctgagctcaaagtcgatgccctgctcgtctatcagggcctgcacctctgggctgaccggctcagcctccttcgcgggcatggagtaggcgccggcagcgttcatgtccgggcccagggcagcggtggtgccataaatgtcggtgatggtggggaggggggccgtcgccacaccattgccgttgctggctgacgcatgcacatgtggcctggctggcaccggcagcactggtctccagccagccagcaagtggctgttcaggaaagcggccatgttgttggtccctgcgcatgtaattccccagatcaaaggagggaacagcttggatttgatgtagtgcccaaccggactgaatgtgcgatggcaggtccctttgagtctcccgaattactagcagggcactgtgacctaacgcagcatgccaaccgcaaaaaaatgattgacagaaaatgaagcggtgtgtcaatatttgctgtatttattcgttttaatcagcaaccaagttcgaaacgcaactatcgtggtgatcaagtgaacctcatcagacttacctcgttcggcaaggaaacggaggcaccaaattccaatttgatattatcgcttgccaagctagagctgatctttgggaaaccaactgccagacagtggactgtgatggagtgccccgagtggtggagcctcttcgattcggttagtcattactaacgtgaaccctcagtgaagggaccatcagaccagaaagaccagatctcctcctcgacaccgagagagtgttgcggcagtaggacgacaag

SEQ ID NO: 3 - protein, 512 aa, Unknown
  Yeast sequence
MTNETSDRPLVHFTPNKGWMNDPNGLWYDEKDAKWHLYFQYNPNDTVWGTPLFWGHATSDDLTNWEDQPIAIAPKRNDSGAFSGSMVVDYNNTSGFFNDTIDPRQRCVAIWTYNTPESEEQYISYSLDGGYTFTEYQKNPVLAANSTQFRDPKVFWYEPSQKWIMTAAKSQDYKIEIYSSDDLKSWKLESAFANEGFLGYQYECPGLIEVPTEQDPSKSYWVMFISINPGAPAGGSFNQYFVGSFNGTHFEAFDNQSRVVDFGKDYYALQTFFNTDPTYGSALGIAWASNWEYSAFVPTNPWRSSMSLVRKFSLNTEYQANPETELINLKAEPILNISNAGPWSRFATNTTLTKANSYNVDLSNSTGTLEFELVYAVNTTQTISKSVFADLSLWFKGLEDPEEYLRMGFEVSASSFFLDRGNSKVKFVKENPYFTNRMSVNNQPFKSENDLSYYKVYGLLDQNILELYFNDGDVVSTNTYFMTTGNALGSVNMTTGVDNLFYIDKFQVREVK

SEQ ID NO: 4 - protein, 20 aa, Unknown
  Yeast sequence
MLLQAFLFLLAGFAAKISAS

SEQ ID NO: 5 - protein, 18 aa, Unknown
  higher plants secretion signal
MANKSLLLLLLLGSLASG

SEQ ID NO: 6 - protein, 10 aa, Artificial Sequence
  synthetic concensus sequence
MARLPLAALG

SEQ ID NO: 7 - protein, 20 aa, Unknown
  synthetic peptide
MANKLLLLLLLLLLPLAASG

SEQ ID NO: 8 - DNA, 2615 bp, Saccharomyces cerevisiae
gaattccccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctctctctacaaatctatctctggcgcgccatatcaatgcttcttcaggcctttctttttcttcttgctggttttgctgccaagatcagcgcctctatgacgaacgaaacctcggatagaccacttgtgcactttacaccaaacaagggctggatgaatgaccccaatggactgtggtacgacgaaaaagatgccaagtggcatctgtactttcaatacaacccgaacgatactgtctgggggacgccattgttttggggccacgccacgtccgacgacctgaccaattgggaggaccaaccaatagctatcgctccgaagaggaacgactccggagcattctcgggttccatggtggttgactacaacaatacttccggctttttcaacgataccattgacccgagacaacgctgcgtggccatatggacttacaacacaccggagtccgaggagcagtacatctcgtatagcctggacggtggatacacttttacagagtatcagaagaaccctgtgcttgctgcaaattcgactcagttccgagatccgaaggtcttttggtacgagccctcgcagaagtggatcatgacagcggcaaagtcacaggactacaagatcgaaatttactcgtctgacgaccttaaatcctggaagctcgaatccgcgttcgcaaacgagggctttctcggctaccaatacgaatgcccaggcctgatagaggtcccaacagagcaagatcccagcaagtcctactgggtgatgtttatttccattaatccaggagcaccggcaggaggttcttttaatcagtacttcgtcggaagctttaacggaactcatttcgaggcatttgataaccaatcaagagtagttgattttggaaaggactactatgccctgcagactttcttcaatactgacccgacctatgggagcgctcttggcattgcgtgggcttctaactgggagtattccgcattcgttcctacaaacccttggaggtcctccatgtcgctcgtgaggaaattctctctcaacactgagtaccaggccaacccggaaaccgaactcataaacctgaaagccgaaccgatcctgaacattagcaacgctggcccctggagccggtttgcaaccaacaccacgttgacgaaagccaacagctacaacgtcgatctttcgaatagcaccggtacacttgaatttgaactggtgtatgccgtcaataccacccaaacgatctcgaagtcggtgttcgcggacctctccctctggtttaaaggcctggaagaccccgaggagtacctcagaatgggtttcgaggtttctgcgtcctccttcttccttgatcgcgggaacagcaaagtaaaatttgttaaggagaacccatattttaccaacaggatgagcgttaacaaccaaccattcaagagcgaaaacgacctgtcgtactacaaagtgtatggtttgcttgatcaaaatatcctggaactctacttcaacgatggtgatgtcgtgtccaccaacacatacttcatgacaaccgggaacgcactgggctccgtgaacatgacgacgggtgtggataacctgttctacatcgacaaattccaggtgagggaagtcaagtgagatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaattaa

SEQ ID NO: 9 - DNA, 22 bp, Prototheca moriformis
tgttgaagaatgagccggcgac

SEQ ID NO: 10 - DNA, 20 bp, Prototheca moriformis
cagtgagctattacgcactc

SEQ ID NO: 11 - DNA, 541 bp, Prototheca kruegani
tgttgaagaatgagccggcgagttaaaaagagtggcatggttaaagaaaatactctggagccatagcgaaagcaagtttagtaagcttaggtcattctttttagacccgaaaccgagtgatctacccatgatcagggtgaagtgttagtaaaataacatggaggcccgaaccgactaatgttgaaaaattagcggatgaattgtgggtaggggcgaaaaaccaatcgaactcggagttagctggttctccccgaaatgcgtttaggcgcagcagtagcagtacaaatagaggggtaaagcactgtttcttttgtgggcttcgaaagttgtacctcaaagtggcaaactctgaatactctatttagatatctactagtgagaccttgggggataagctccttggtcaaaagggaaacagcccagatcaccagttaaggccccaaaatgaaaatgatagtgactaaggatgtgggtatgtcaaaacctccagcaggttagcttagaagcagcaatcctttcaagagtgcgtaatagctcactg

SEQ ID NO: 12 - DNA, 573 bp, Prototheca wickerhamii
tgttgaagaatgagccggcgacttaaaataaatggcaggctaagagatttaataactcgaaacctaagcgaaagcaagtcttaatagggcgtcaatttaacaaaactttaaataaattataaagtcatttattttagacccgaacctgagtgatctaaccatggtcaggatgaaacttgggtgacaccaagtggaagtccgaaccgaccgatgttgaaaaatcggcggatgaactgtggttagtggtgaaataccagtcgaactcagagctagctggttctccccgaaatgcgttgaggcgcagcaatatatctcgtctatctaggggtaaagcactgtttcggtgcgggctatgaaaatggtaccaaatcgtggcaaactctgaatactagaaatgacgatatattagtgagactatgggggataagctccatagtcgagagggaaacagcccagaccaccagttaaggccccaaaatgataatgaagtggtaaaggaggtgaaaatgcaaatacaaccaggaggttggcttagaagcagccatcctttaaagagtgcgtaatagctcactg

SEQ ID NO: 13 - DNA, 541 bp, Prototheca stagnora
tgttgaagaatgagccggcgagttaaaaaaaatggcatggttaaagatatttctctgaagccatagcgaaagcaagttttacaagctatagtcattttttttagacccgaaaccgagtgatctacccatgatcagggtgaagtgttggtcaaataacatggaggcccgaaccgactaatggtgaaaaattagcggatgaattgtgggtaggggcgaaaaaccaatcgaactcggagttagctggttctccccgaaatgcgtttaggcgcagcagtagcaacacaaatagaggggtaaagcactgtttcttttgtgggcttcgaaagttgtacctcaaagtggcaaactctgaatactctatttagatatctactagtgagaccttgggggataagctccttggtcaaaagggaaacagcccagatcaccagttaaggccccaaaatgaaaatgatagtgactaaggacgtgagtatgtcaaaacctccagcaggttagcttagaagcagcaatcctttcaagagtgcgtaatagctcactg

SEQ ID NO: 14 - DNA, 541 bp, Prototheca moriformis
tgttgaagaatgagccggcgagttaaaaagagtggcatggttaaagataattctctggagccatagcgaaagcaagtttaacaagctaaagtcaccctttttagacccgaaaccgagtgatctacccatgatcagggtgaagtgttggtaaaataacatggaggcccgaaccgactaatggtgaaaaattagcggatgaattgtgggtaggggcgaaaaaccaatcgaactcggagttagctggttctccccgaaatgcgtttaggcgcagcagtagcaacacaaatagaggggtaaagcactgtttcttttgtgggcttcgaaagttgtacctcaaagtggcaaactctgaatactctatttagatatctactagtgagaccttgggggataagctccttggtcaaaagggaaacagcccagatcaccagttaaggccccaaaatgaaaatgatagtgactaaggatgtgggtatgttaaaacctccagcaggttagcttagaagcagcaatcctttcaagagtgcgtaatagctcactg

SEQ ID NO: 15 - DNA, 573 bp, Prototheca moriformis
tgttgaagaatgagccggcgacttaaaataaatggcaggctaagagaattaataactcgaaacctaagcgaaagcaagtcttaatagggcgctaatttaacaaaacattaaataaaatctaaagtcatttattttagacccgaacctgagtgatctaaccatggtcaggatgaaacttgggtgacaccaagtggaagtccgaaccgaccgatgttgaaaaatcggcggatgaactgtggttagtggtgaaataccagtcgaactcagagctagctggttctccccgaaatgcgttgaggcgcagcaatatatctcgtctatctaggggtaaagcactgtttcggtgcgggctatgaaaatggtaccaaatcgtggcaaactctgaatactagaaatgacgatatattagtgagactatgggggataagctccatagtcgagagggaaacagcccagaccaccagttaaggccccaaaatgataatgaagtggtaaaggaggtgaaaatgcaaatacaaccaggaggttggcttagaagcagccatcctttaaagagtgcgtaatagctcactg

SEQ ID NO: 16 - DNA, 573 bp, Prototheca wickerhamii
tgttgaagaatgagccgtcgacttaaaataaatggcaggctaagagaattaataactcgaaacctaagcgaaagcaagtcttaatagggcgctaatttaacaaaacattaaataaaatctaaagtcatttattttagacccgaacctgagtgatctaaccatggtcaggatgaaacttgggtgacaccaagtggaagtccgaaccgaccgatgttgaaaaatcggcggatgaactgtggttagtggtgaaataccagtcgaactcagagctagctggttctccccgaaatgcgttgaggcgcagcaatatatctcgtctatctaggggtaaagcactgtttcggtgcgggctatgaaaatggtaccaaatcgtggcaaactctgaatactagaaatgacgatatattagtgagactatgggggataagctccatagtcgagagggaaacagcccagaccaccagttaaggccccaaaatgataatgaagtggtaaaggaggtgaaaatgcaaatacaaccaggaggttggcttagaagcagccatcctttaaagagtgcgtaatagctcactg

SEQ ID NO: 17 - DNA, 541 bp, Prototheca moriformis
tgttgaagaatgagccggcgagttaaaaagagtggcgtggttaaagaaaattctctggaaccatagcgaaagcaagtttaacaagcttaagtcactttttttagacccgaaaccgagtgatctacccatgatcagggtgaagtgttggtaaaataacatggaggcccgaaccgactaatggtgaaaaattagcggatgaattgtgggtaggggcgaaaaaccaatcgaactcggagttagctggttctccccgaaatgcgtttaggcgcagcagtagcaacacaaatagaggggtaaagcactgtttcttttgtgggctccgaaagttgtacctcaaagtggcaaactctgaatactctatttagatatctactagtgagaccttgggggataagctccttggtcgaaagggaaacagcccagatcaccagttaaggccccaaaatgaaaatgatagtgactaaggatgtgagtatgtcaaaacctccagcaggttagcttagaagcagcaatcctttcaagagtgcgtaatagctcactg

SEQ ID NO: 18 - DNA, 541 bp, Prototheca zopfii
tgttgaagaatgagccggcgagttaaaaagagtggcatggttaaagaaaattctctggagccatagcgaaagcaagtttaacaagcttaagtcactttttttagacccgaaaccgagtgatctacccatgatcagggtgaagtgttggtaaaataacatggaggcccgaaccgactaatggtgaaaaattagcggatgaattgtgggtaggggcgaaaaaccaatcgaactcggagttagctggttctccccgaaatgcgtttaggcgcagcagtagcaacacaaatagaggggtaaagcactgtttctttcgtgggcttcgaaagttgtacctcaaagtggcaaactctgaatactctatttagatatctactagtgagaccttgggggataagctccttggtcaaaagggaaacagcccagatcaccagttaaggccccaaaatgaaaatgatagtgactaaggatgtgagtatgtcaaaacctccagcaggttagcttagaagcagcaatcctttcaagagtgcgtaatagctcactg

SEQ ID NO: 19 - DNA, 565 bp, Prototheca moriformis
tgttgaagaatgagccggcgacttagaaaaggtggcatggttaaggaaatattccgaagccgtagcaaaagcgagtctgaatagggcgataaaatatattaatatttagaatctagtcattttttctagacccgaacccgggtgatctaaccatgaccaggatgaagcttgggtgataccaagtgaaggtccgaaccgaccgatgttgaaaaatcggcggatgagttgtggttagcggtgaaataccagtcgaacccggagctagctggttctccccgaaatgcgttgaggcgcagcagtacatctagtctatctaggggtaaagcactgtttcggtgcgggctgtgagaacggtaccaaatcgtggcaaactctgaatactagaaatgacgatgtagtagtgagactgtgggggataagctccattgtcaagagggaaacagcccagaccaccagctaaggccccaaaatggtaatgtagtgacaaaggaggtgaaaatgcaaatacaaccaggaggttggcttagaagcagccatcctttaaagagtgcgtaatagctcactg

SEQ ID NO: 20 - protein, 550 aa, Chicorium intybus
MSNSSNASESLFPATSEQPYRTAFHFQPPQNWMNDPNGPMCYNGVYHLFYQYNPFGPLWNLRMYWAHSVSHDLINWIHLDLAFAPTEPFDINGCLSGSATVLPGNKPIMLYTGIDTENRQVQNLAVPKDLSDPYLREWVKHTGNPIISLPEEIQPDDFRDPTTTWLEEDGTWRLLVGSQKDKTGIAFLYHSGDFVNWTKSDSPLHKVSGTGMWECVDFFPVWVDSTNGVDTSIINPSNRVKHVLKLGIQDHGKDCYLIGKYSADKENYVPEDELTLSTLRLDYGMYYASKSFFDPVKNRRIMTAWVNESDSEADVIARGWSGVQSFPRSLWLDKNQKQLLQWPIEEIEMLHQNEVSFHNKKLDGGSSLEVLGITASQADVKISFKLANLEEAEELDPSWVDPQLICSENDASKKGKFGPFGLLALASSDLREQTAIFFRVFRKNGRYVVLMCSDQSRSSMKNGIEKRTYGAFVDIDPQQDEISLRTLIDHSIVESFGGRGKTCITTRVYPTLAIGEQARLFAFNHGTESVEISELSAWSMKKAQMKVEEP

SEQ ID NO: 21 - protein, 581 aa, Schizosaccharomyces pombe
MFLKYILASGICLVSLLSSTNAAPRHLYVKRYPVIYNASNITEVSNSTTVPPPPFVNTTAPNGTCLGNYNEYLPSGYYNATDRPKIHFTPSSGFMNDPNGLVYTGGVYHMFFQYSPKTLTAGEVHWGHTVSKDLIHWENYPIAIYPDEHENGVLSLPFSGSAVVDVHNSSGLFSNDTIPEERIVLIYTDHWTGVAERQAIAYTTDGGYTFKKYSGNPVLDINSLQFRDPKVIWDFDANRWVMIVAMSQNYGIAFYSSYDLIHWTELSVFSTSGYLGLQYECPGMARVPVEGTDEYKWVLFISINPGAPLGGSVVQYFVGDWNGTNFVPDDGQTRFVDLGKDFYASALYHSSSANADVIGVGWASNWQYTNQAPTQVFRSAMTVARKFTLRDVPQNPMTNLTSLIQTPLNVSLLRDETLFTAPVINSSSSLSGSPITLPSNTAFEFNVTLSINYTEGCTTGYCLGRIIIDSDDPYRLQSISVDVDFAASTLVINRAKAQMGWFNSLFTPSFANDIYIYGNVTLYGIVDNGLLELYVNNGEKTYTNDFFFLQGATPGQISFAAFQGVSFNNVTVTPLKTIWNC

SEQ ID NO: 22 - protein, 550 aa, Pichia anomala
MIQLSPLLLLPLFSVFNSIADASTEYLRPQIHLTPDQGWMNDPNGMFYDRKDKLWHVYFQHNPDKKSIWATPVTWGHSTSKDLLTWDYHGNALEPENDDEGIFSGSVVVDRNNTSGFFNDSTDPEQRIVAIYTNNAQLQTQEIAYSLDKGYSFIKYDQNPVINVNSSQQRDPKVLWHDESNQWIMVVAKTQEFKVQIYGSPDLKKWDLKSNFTSNGYLGFQYECPGLFKLPIENPLNDTVTSKWVLLLAINPGSPLGGSINEYFIGDFDGTTFHPDDGATRFMDIGKDFYAFQSFDNTEPEDGALGLAWASNWQYANTVPTENWRSSMSLVRNYTLKYVDVNPENYGLTLIQKPVYDTKETRLNETLKTLETINEYEVNDLKLDKSSFVATDFNTERNATGVFEFDLKFTQTDLKMGYSNMTTQFGLYIHSQTVKGSQETLQLVFDTLSTTWYIDRTTQHSFQRNSPVFTERISTYVEKIDTTDQGNVYTLYGVVDRNILELYFNDGSIAMTNTFFFREGKIPTSFEVVCDSEKSFITIDELSVRELARK

SEQ ID NO: 23 - protein, 533 aa, Debaryomyces occidentalis
MVQVLSVLVIPLLTLFFGYVASSSIDLSVDTSEYNRPLIHFTPEKGWMNDPNGLFYDKTAKLWHLYFQYNPNATAWGQPLYWGHATSNDLVHWDEHEIAIGPEHDNEGIFSGSIVVDHNNTSGFFNSSIDPNQRIVAIYTNNIPDLQTQDIAFSLDGGYTFTKYENNPVIDVSSNQFRDPKVFWHERFKSMDHGCSEIARVKIQIFGSANLKNWVLNSNFSSGYYGNQYGMSRLIEVPIENSDKSKWVMFLAINPGSPLGGSINQYFVGDFDGFQFVPDDSQTRFVDIGKDFYAFQTFSEVEHGVLGLAWASNWQYADQVPTNPWRSSTSLARNYTLRYVIQMLKLTANIDKSVLPDSINVVDKLKKKNVKLTNKKPIKTNFKGSTGLFDFNITFKVLNLNVSPGKTHFDILINSQELNSSVDSIKIGFDSSQSLFYIDRHIPNVEFPRKQFFTDKLAAYLEPLDYDQDLRVFSLYGIVDKNIIELYFNDGTVAMTNTFFMGEGKYPHDIQIVTDTEEPLFELESVIIRELNK

SEQ ID NO: 24 - protein, 654 aa, Oryza sativa
MATSRLTPAYDLKNAAAAVYTPLPEQPHSAEVEIRDRKPFKIISAIILSSLLLLALILVAVNYQAPPSHSSGDNSQPAAVMPPSRGVSQGVSEKAFRGASGAGNGVSFAWSNLMLSWQRTSYHFQPVKNWMNDPNGPLYYKGWYHLFYQYNPDSAVWGNITWGHAVSTDLINWLHLPFAMVPDQWYDVNGVWTGSATILPDGRIVMLYTGDTDDYVQDQNLAFPANLSDPLLVDWVKYPNNPVIYPPPGIGVKDFRDPTTAGTAGMQNGQRLVTIGSKVGKTGISLVYETTNFTTFKLLYGVLHAVPGTGMWECVDLYPVSTTGENGLDTSVNGLGVKHVLKTSLDDDKHDYYALGTYDPVKNKWTPDNPDLDVGIGLRLDYGKYYAARTFYDQNKQRRILWGWIGETDLEAVDLMKGWASLQAIPRTIVFDKKTGTNVLQRPEEEVESWSSGDPITQRRIFEPGSVVPIHVSGATQLDITASFEVDETLLETTSESHDAGYDCSNSGGAGTRGSLGPFGLLVVADEKLSELTPVYLYVAKGGDGKAKAHLCAYQTRSSMASGVEKEVYGSAVPVLDGENYSARILIDHSIVESFAQAGRTCVRSRDYPTKDIYGAARCFFFNNATEASVRASLKAWQMKSFIRPYPFIPDQKS

SEQ ID NO: 25 - protein, 690 aa, Allium cepa
MSSDDLESPPSSYLPIPPSDEFHDQPPPLRSWLRLLSIPLALMFLLFLATFLSNLESPPSDSGLVSDPVTFDVNPAVVRRGKDAGVSDKTSGVDSGFVLDPVAVDANSVVVHRGKDAGVSDKTSGVDSGLLKDSPLGPYPWTNQMLSWQRTGFHFQPVKNWMNDPNGPLYYKGWYHFFYQYNPEGAVWGNIAWGHAVSRDLVHWTHLPLAMVPDQWYDINGVWTGSATILPDGQIVMLYTGATNESVQVQNLAVPADQSDTLLLRWKKSEANPILVPPPGIGDKDFRDPTTAWYEPSDDTWRIVIGSKDSSHSGIAIVYSTKDFINYKLIPGILHAVERVGMWECVDFYPVATADSSHANHGLDPSARPSPAVKHVLKASMDDDRHDYYAIGTYDPAQNTWVPDDASVDVGIGLRYDWGKFYASKTFYDHAKKRRILWSWIGETDSETADIAKGWASLQGVPRTVLLDVKTGSNLITWPVVEIESLRTRPRDFSGITVDAGSTFKLDVGGAAQLDIEAEFKISSEELEAVKEADVSYNCSSSGGAAERGVLGPFGLLVLANQDLTEQTATYFYVSRGMDGGLNTHFCQDEKRSSKASDIVKRIVGHSVPVLDGESFALRILVDHSIVESFAQGGRASATSRVYPTEAIYNNARVFVFNNATGAKVTAQSLKVWHMSTAINEIYDPATSVM

SEQ ID NO: 26 - protein, 501 aa, Beta vulgaris
  misc_feature (382)..(382): Xaa can be any naturally occurring amino acid
LFYQYNPNGVIWGPPVWGHSTSKDLVNWVPQPLTMEPEMAANINGSWSGSATILPGNKPAILFTGLDPKYEQVQVLAYPKDTSDPNLKEWFLAPQNPVMFPTPQNQINATSFRDPTTAWRLPDGVWRLLIGSKRGQRGLSLLFRSRDFVHWVQAKHPLYSDKLSGMWECPDFFPVYANGDQMGVDTSIIGSHVKHVLKNSLDITKHDIYTIGDYNIKKDAYTPDIGYMNDSSLRYDYGKYYASKTFFDDAKKERILLGWANESSSVEDDIKKGWSGIHTIPRKIWLDKLGKQLIQWPIANIEKLRQKPVNIYRKVLKGGSQIEVSGITAAQADVEISFKIKDLKNVEKFDASWTSPQLLCSKKGASVKGGLGPFGLLTLASXGLEEYTAVFFRIFKAYDNKFVVLMCSDQSRSSLNPTNDKTTYGTFVDVNPIREGLSLRVLIDHSVVESFGAKGKNVITARVYPTLAINEKAHLYVFNRGTSNVEITGLTAWSMKKANIA

SEQ ID NO: 27 - protein, 518 aa, Bifidobacterium breve
MTDFTPETPVLTPIRDHAAELAKAEAGVAEMAAKRNNRWYPKYHIASNGGWINDPNGLCFYKGRWHVFYQLHPYGTQWGPMHWGHVSSTDMLNWKREPIMFAPSLEQEKDGVFSGSAVIDDNGDLRFYYTGHRWANGHDNTGGDWQVQMTALPDNDELTSATKQGMIIDCPTDKVDHHYRDPKVWKTGDTWYMTFGVSSEDKRGQMWLFSSKDMVRWEYERVLFQHPDPDVFMLECPDFFPIKDKDGNEKWVIGFSAMGSKPSGFMNRNVNNAGYMIGTWEPGGEFKPETEFRLWDCGHNYYAPQSFNVDGRQIVYGWMSPFVQPIPMEDDGWCGQLTLPREITLDDDGDVVTAPVAEMEGLREDTLDHGSITLDMDGEQVIADDAEAVEIEMTIDLAASTADRAGLKIHATEDGAYTYVAYDDQIGRVVVDRQAMANGDHGYRAAPLTDAELASGKLDLRVFVDRGSVEVYVNGGHQVLSSYSYASEGPRAIKLVAEFGNLKVESLKLHHMKSIGLE

SEQ ID NO: 28 - protein, 532 aa, Saccharomyces cerevisae
MLLQAFLFLLAGFAAKISASMTNETSDRPLVHFTPNKGWMNDPNGLWYDEKDAKWHLYFQYNPNDTVWGTPLFWGHATSDDLTNWEDQPIAIAPKRNDSGAFSGSMVVDYNNTSGFFNDTIDPRQRCVAIWTYNTPESEEQYISYSLDGGYTFTEYQKNPVLAANSTQFRDPKVFWYEPSQKWIMTAAKSQDYKIEIYSSDDLKSWKLESAFANEGFLGYQYECPGLIEVPTEQDPSKSYWVMFISINPGAPAGGSFNQYFVGSFNGTHFEAFDNQSRVVDFGKDYYALQTFFNTDPTYGSALGIAWASNWEYSAFVPTNPWRSSMSLVRKFSLNTEYQANPETELINLKAEPILNISNAGPWSRFATNTTLTKANSYNVDLSNSTGTLEFELVYAVNTTQTISKSVFADLSLWFKGLEDPEEYLRMGFEVSASSFFLDRGNSKVKFVKENPYFTNRMSVNNQPFKSENDLSYYKVYGLLDQNILELYFNDGDVVSTNTYFMTTGNALGSVNMTTGVDNLFYIDKFQVREVK

SEQ ID NO: 29 - protein, 512 aa, Zymomonas mobilis
MESPSYKNLIKAEDAQKKAGKRLLSSEWYPGFHVTPLTGWMNDPNGLIFFKGEYHLFYQYYPFAPVWGPMHWGHAKSRDLVHWETLPVALAPGDLFDRDGCFSGCAVDNNGVLTLIYTGHIVLSNDSPDAIREVQCMATSIDGIHFQKEGIVLEKAPMPQVAHFRDPRVWKENDHWFMVVGYRTDDEKHQGIGHVALYRSENLKDWIFVKTLLGDNSQLPLGKRAFMWECPDFFSLGNRSVLMFSPQGLKASGYKNRNLFQNGYILGKWQAPQFTPETSFQELDYGHDFYAAQRFEAKDGRQILIAWFDMWENQKPSQRDGWAGCMTLPRKLDLIDNKIVMTPVREMEILRQSEKIESVVTLSDAEHPFTMDSPLQEIELIFDLEKSSAYQAGLALRCNGKGQETLLYIDRSQNRIILDRNRSGQNVKGIRSCPLPNTSKVRLHIFLDRSSIEIFVGDDQTQGLYSISSRIFPDKDSLKGRLFAIEGYAVFDSFKRWTLQDANLAAFSSDAC

SEQ ID NO: 30 - protein, 360 aa, Artificial Sequence
  synthetic construct
MAIKTNRQPVEKPPFTIGTLRKAIPAHCFERSALRGRAPDWSMLFAVITTIFSAAEKQWTNLEWKPKPNPPQLLDDHFGPHGLVFRRTFAIRSYEVGPDRSTSIVAVMNHLQEAALNHAKSVGILGDGFGTTLEMSKRDLIWVVKRTHVAVERYPAWGDTVEVECWVGASGNNGRRHDFLVRDCKTGEILTRCTSLSVMMNTRTRRLSKIPEEVRGEIGPAFIDNVAVKDEEIKKPQKLNDSTADYIQGGLTPRWNDLDINQHVNNIKYVDWILETVPDSIFESHHISSFTIEYRRECTMDSVLQSLTTVSGGSSEAGLVCEHLLQLEGGSEVLRAKTEWRPKLTDSFRGISVIPAESSV

SEQ ID NO: 31 - DNA, 4653 bp, Artificial Sequence
  synthetic construct
ggtacccgcctgcaacgcaagggcagccacagccgctcccacccgccgctgaaccgacacgtgcttgggcgcctgccgcctgcctgccgcatgcttgtgctggtgaggctgggcagtgctgccatgctgattgaggcttggttcatcgggtggaagcttatgtgtgtgctgggcttgcatgccgggcaatgcgcatggtggcaagagggcggcagcacttgctggagctgccgcggtgcctccaggtggttcaatcgcggcagccagagggatttcagatgatcgcgcgtacaggttgagcagcagtgtcagcaaaggtagcagtttgccagaatgatcggttcagctgttaatcaatgccagcaagagaaggggtcaagtgcaaacacgggcatgccacagcacgggcaccggggagtggaatggcaccaccaagtgtgtgcgagccagcatcgccgcctggctgtttcagctacaacggcaggagtcatccaacgtaaccatgagctgatcaacactgcaatcatcgggcgggcgtgatgcaagcatgcctggcgaagacacatggtgtgcggatgctgccggctgctgcctgctgcgcacgccgttgagttggcagcaggctcagccatgcactggatggcagctgggctgccactgcaatgtggtggataggatgcaagtggagcgaataccaaaccctctggctgcttgctgggttgcatggcatcgcaccatcagcaggagcgcatgcgaagggactggccccatgcacgccatgccaaaccggagcgcaccgagtgtccacactgtcaccaggcccgcaagctttgcagaaccatgctcatggacgcatgtagcgctgacgtcccttgacggcgctcctctcgggtgtgggaaacgcaatgcagcacaggcagcagaggcggcggcagcagagcggcggcagcagcggcgggggccacccttcttgcggggtcgcgccccagccagcggtgatgcgctgatcccaaacgagttcacattcatttgcatgcctggagaagcgaggctggggcctttgggctggtgcagcccgcaatggaatgcgggaccgccaggctagcagcaaaggcgcctcccctactccgcatcgatgttccatagtgcattggactgcatttgggtggggcggccggctgtttctttcgtgttgcaaaacgcgccagctcagcaacctgtcccgtgggtcccccgtgccgatgaaatcgtgtgcacgccgatcagctgattgcccggctcgcgaagtaggcgccctcctttctgctcgccctctctccgtcccgcctctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggctatcaagacgaacaggcagcctgtggagaagcctccgttcacgatcgggacgctgcgcaaggccatccccgcgcactgtttcgagcgctcggcgcttcgtgggcgcgcccccgactggtccatgctgttcgccgtgatcaccaccatcttctccgccgccgagaagcagtggaccaacctggagtggaagcccaagcccaaccccccccagctgctggacgaccacttcggcccccacggcctggtgttccgccgcaccttcgccatccgcagctacgaggtgggccccgaccgctccaccagcatcgtggccgtgatgaaccacctgcaggaggccgccctgaaccacgccaagtccgtgggcatcctgggcgacggcttcggcaccaccctggagatgtccaagcgcgacctgatctgggtggtgaagcgcacccacgtggccgtggagcgctaccccgcctggggcgacaccgtggaggtggagtgctgggtgggcgcctccggcaacaacggccgccgccacgacttcctggtgcgcgactgcaagaccggcgagatcctgacccgctgcacctccctgagcgtgatgatgaacacccgcacccgccgcctgagcaagatccccgaggaggtgcgcggcgagatcggccccgccttcatcgacaacgtggccgtgaaggacgaggagatcaagaagccccagaagctgaacgactccaccgccgactacatccagggcggcctgaccccccgctggaacgacctggacatcaaccagcacgtgaacaacatcaagtacgtggactggatcctggagaccgtgcccgacagcatcttcgagagccaccacatctcctccttcaccatcgagtaccgccgcgagtgcaccatggacagcgtgctgcagtccctgaccaccgtgagcggcggctcctccgaggccggcctggtgtgcgagcacctgctgcagctggagggcggcagcgaggtgctgcgcgccaagaccgagtggcgccccaagctgaccgactccttccgcggcatcagcgtgatccccgccgagtccagcgtgatggactacaaggaccacgacggcgactacaaggaccacgacatcgactacaaggacgacgacgacaagtgatgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctt

SEQ ID NO: 32 - protein, 366 aa, Artificial Sequence
  synthetic construct
MAIKTNRQPVEKPPFTIGTLRKAIPAHCFERSALRGRAQLPDWSRLLTAITTVFVKSKRPDMHDRKSKRPDMLVDSFGLESTVQDGLVFRQSFSIRSYEIGTDRTASIETLMNHLQETSLNHCKSTGILLDGFGRTLEMCKRDLIWVVIKMQIKVNRYPAWGDTVEINTRFSRLGKIGMGRDWLISDCNTGEILVRATSAYAMMNQKTRRLSKLPYEVHQEIVPLFVDSPVIEDSDLKVHKFKVKTGDSIQKGLTPGWNDLDVNQHVSNVKYIGWILESMPTEVLETQELCSLALEYRRECGRDSVLESVTAMDPSKVGVRSQYQHLLRLEDGTAIVNGATEWRPKNAGANGAISTGKTSNGNSVS

SEQ ID NO: 33 - DNA, 4668 bp, Artificial Sequence
  synthetic construct
ggtacccgcctgcaacgcaagggcagccacagccgctcccacccgccgctgaaccgacacgtgcttgggcgcctgccgcctgcctgccgcatgcttgtgctggtgaggctgggcagtgctgccatgctgattgaggcttggttcatcgggtggaagcttatgtgtgtgctgggcttgcatgccgggcaatgcgcatggtggcaagagggcggcagcacttgctggagctgccgcggtgcctccaggtggttcaatcgcggcagccagagggatttcagatgatcgcgcgtacaggttgagcagcagtgtcagcaaaggtagcagtttgccagaatgatcggttcagctgttaatcaatgccagcaagagaaggggtcaagtgcaaacacgggcatgccacagcacgggcaccggggagtggaatggcaccaccaagtgtgtgcgagccagcatcgccgcctggctgtttcagctacaacggcaggagtcatccaacgtaaccatgagctgatcaacactgcaatcatcgggcgggcgtgatgcaagcatgcctggcgaagacacatggtgtgcggatgctgccggctgctgcctgctgcgcacgccgttgagttggcagcaggctcagccatgcactggatggcagctgggctgccactgcaatgtggtggataggatgcaagtggagcgaataccaaaccctctggctgcttgctgggttgcatggcatcgcaccatcagcaggagcgcatgcgaagggactggccccatgcacgccatgccaaaccggagcgcaccgagtgtccacactgtcaccaggcccgcaagctttgcagaaccatgctcatggacgcatgtagcgctgacgtcccttgacggcgctcctctcgggtgtgggaaacgcaatgcagcacaggcagcagaggcggcggcagcagagcggcggcagcagcggcgggggccacccttcttgcggggtcgcgccccagccagcggtgatgcgctgatcccaaacgagttcacattcatttgcatgcctggagaagcgaggctggggcctttgggctggtgcagcccgcaatggaatgcgggaccgccaggctagcagcaaaggcgcctcccctactccgcatcgatgttccatagtgcattggactgcatttgggtggggcggccggctgtttctttcgtgttgcaaaacgcgccagctcagcaacctgtcccgtgggtcccccgtgccgatgaaatcgtgtgcacgccgatcagctgattgcccggctcgcgaagtaggcgccctcctttctgctcgccctctctccgtcccgcctctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggctatcaagacgaacaggcagcctgtggagaagcctccgttcacgatcgggacgctgcgcaaggccatccccgcgcactgtttcgagcgctcggcgcttcgtgggcgcgcccagctgcccgactggagccgcctgctgaccgccatcaccaccgtgttcgtgaagtccaagcgccccgacatgcacgaccgcaagtccaagcgccccgacatgctggtggacagcttcggcctggagtccaccgtgcaggacggcctggtgttccgccagtccttctccatccgctcctacgagatcggcaccgaccgcaccgccagcatcgagaccctgatgaaccacctgcaggagacctccctgaaccactgcaagagcaccggcatcctgctggacggcttcggccgcaccctggagatgtgcaagcgcgacctgatctgggtggtgatcaagatgcagatcaaggtgaaccgctaccccgcctggggcgacaccgtggagatcaacacccgcttcagccgcctgggcaagatcggcatgggccgcgactggctgatctccgactgcaacaccggcgagatcctggtgcgcgccaccagcgcctacgccatgatgaaccagaagacccgccgcctgtccaagctgccctacgaggtgcaccaggagatcgtgcccctgttcgtggacagccccgtgatcgaggactccgacctgaaggtgcacaagttcaaggtgaagaccggcgacagcatccagaagggcctgacccccggctggaacgacctggacgtgaaccagcacgtgtccaacgtgaagtacatcggctggatcctggagagcatgcccaccgaggtgctggagacccaggagctgtgctccctggccctggagtaccgccgcgagtgcggccgcgactccgtgctggagagcgtgaccgccatggaccccagcaaggtgggcgtgcgctcccagtaccagcacctgctgcgcctggaggacggcaccgccatcgtgaacggcgccaccgagtggcgccccaagaacgccggcgccaacggcgccatctccaccggcaagaccagcaacggcaactccgtgtccatggactacaaggaccacgacggcgactacaaggaccacgacatcgactacaaggacgacgacgacaagtgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctt

SEQ ID NO: 34 - protein, 360 aa, Artificial Sequence
  synthetic construct
MAIKTNRQPVEKPPFTIGTLRKAIPAHCFERSALRGRAPDWSMLFAVITTIFSAAEKQWTNLEWKPKPKLPQLLDDHFGLHGLVFRRTFAIRSYEVGPDRSTSILAVMNHMQEATLNHAKSVGILGDGFGTTLEMSKRDLMWVVRRTHVAVERYPTWGDTVEVECWIGASGNNGMRRDFLVRDCKTGEILTRCTSLSVLMNTRTRRLSTIPDEVRGEIGPAFIDNVAVKDDEIKKLQKLNDSTADYIQGGLTPRWNDLDVNQHVNNLKYVAWVFETVPDSIFESHHISSFTLEYRRECTRDSVLRSLTTVSGGSSEAGLVCDHLLQLEGGSEVLRARTEWRPKLTDSFRGISVIPAEPRV

SEQ ID NO: 35 - DNA, 4653 bp, Artificial Sequence
  synthetic construct
ggtacccgcctgcaacgcaagggcagccacagccgctcccacccgccgctgaaccgacacgtgcttgggcgcctgccgcctgcctgccgcatgcttgtgctggtgaggctgggcagtgctgccatgctgattgaggcttggttcatcgggtggaagcttatgtgtgtgctgggcttgcatgccgggcaatgcgcatggtggcaagagggcggcagcacttgctggagctgccgcggtgcctccaggtggttcaatcgcggcagccagagggatttcagatgatcgcgcgtacaggttgagcagcagtgtcagcaaaggtagcagtttgccagaatgatcggttcagctgttaatcaatgccagcaagagaaggggtcaagtgcaaacacgggcatgccacagcacgggcaccggggagtggaatggcaccaccaagtgtgtgcgagccagcatcgccgcctggctgtttcagctacaacggcaggagtcatccaacgtaaccatgagctgatcaacactgcaatcatcgggcgggcgtgatgcaagcatgcctggcgaagacacatggtgtgcggatgctgccggctgctgcctgctgcgcacgccgttgagttggcagcaggctcagccatgcactggatggcagctgggctgccactgcaatgtggtggataggatgcaagtggagcgaataccaaaccctctggctgcttgctgggttgcatggcatcgcaccatcagcaggagcgcatgcgaagggactggccccatgcacgccatgccaaaccggagcgcaccgagtgtccacactgtcaccaggcccgcaagctttgcagaaccatgctcatggacgcatgtagcgctgacgtcccttgacggcgctcctctcgggtgtgggaaacgcaatgcagcacaggcagcagaggcggcggcagcagagcggcggcagcagcggcgggggccacccttcttgcggggtcgcgccccagccagcggtgatgcgctgatcccaaacgagttcacattcatttgcatgcctggagaagcgaggctggggcctttgggctggtgcagcccgcaatggaatgcgggaccgccaggctagcagcaaaggcgcctcccctactccgcatcgatgttccatagtgcattggactgcatttgggtggggcggccggctgtttctttcgtgttgcaaaacgcgccagctcagcaacctgtcccgtgggtcccccgtgccgatgaaatcgtgtgcacgccgatcagctgattgcccggctcgcgaagtaggcgccctcctttctgctcgccctctctccgtcccgcctctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggctatcaagacgaacaggcagcctgtggagaagcctccgttcacgatcgggacgctgcgcaaggccatccccgcgcactgtttcgagcgctcggcgcttcgtgggcgcgcccccgactggtccatgctgttcgccgtgatcaccaccatcttcagcgccgccgagaagcagtggaccaacctggagtggaagcccaagcccaagctgccccagctgctggacgaccacttcggcctgcacggcctggtgttccgccgcaccttcgccatccgctcctacgaggtgggccccgaccgcagcacctccatcctggccgtgatgaaccacatgcaggaggccaccctgaaccacgccaagagcgtgggcatcctgggcgacggcttcggcaccaccctggagatgtccaagcgcgacctgatgtgggtggtgcgccgcacccacgtggccgtggagcgctaccccacctggggcgacaccgtggaggtggagtgctggatcggcgccagcggcaacaacggcatgcgccgcgacttcctggtgcgcgactgcaagaccggcgagatcctgacccgctgcacctccctgagcgtgctgatgaacacccgcacccgccgcctgagcaccatccccgacgaggtgcgcggcgagatcggccccgccttcatcgacaacgtggccgtgaaggacgacgagatcaagaagctgcagaagctgaacgactccaccgccgactacatccagggcggcctgaccccccgctggaacgacctggacgtgaaccagcacgtgaacaacctgaagtacgtggcctgggtgttcgagaccgtgcccgacagcatcttcgagtcccaccacatcagctccttcaccctggagtaccgccgcgagtgcacccgcgactccgtgctgcgcagcctgaccaccgtgagcggcggcagctccgaggccggcctggtgtgcgaccacctgctgcagctggagggcggcagcgaggtgctgcgcgcccgcaccgagtggcgccccaagctgaccgactccttccgcggcatcagcgtgatccccgccgagccccgcgtgatggactacaaggaccacgacggcgactacaaggaccacgacatcgactacaaggacgacgacgacaagtgatgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctt

SEQ ID NO: 36 - protein, 393 aa, Artificial Sequence
  synthetic construct
MAIKTNRQPVEKPPFTIGTLRKAIPAHCFERSALRGRAPANGSAVTLKSGSLNTQEDTLSSSPPPRAFFNQLPDWSMLLTAITTVFVAPEKRWTMFDRKSKRPNMLMDSFGLERVVQDGLVFRQSFSIRSYEICADRTASIETVMNHVQETSLNQCKSIGLLDDGFGRSPEMCKRDLIWVVTRMKIMVNRYPTWGDTIEVSTWLSQSGKIGMGRDWLISDCNTGEILVRATSVYAMMNQKTRRFSKLPHEVRQEFAPHFLDSPPAIEDNDGKLQKFDVKTGDSIRKGLTPGWYDLDVNQHVSNVKYIGWILESMPTEVLETQELCSLTLEYRRECGRDSVLESVTSMDPSKVGDRFQYRHLLRLEDGADIMKGRTEWRPKNAGTNGAISTGKT

SEQ ID NO: 37 - DNA, 4686 bp, Artificial Sequence
  synthetic construct
ggtacccgcctgcaacgcaagggcagccacagccgctcccacccgccgctgaaccgacacgtgcttgggcgcctgccgcctgcctgccgcatgcttgtgctggtgaggctgggcagtgctgccatgctgattgaggcttggttcatcgggtggaagcttatgtgtgtgctgggcttgcatgccgggcaatgcgcatggtggcaagagggcggcagcacttgctggagctgccgcggtgcctccaggtggttcaatcgcggcagccagagggatttcagatgatcgcgcgtacaggttgagcagcagtgtcagcaaaggtagcagtttgccagaatgatcggttcagctgttaatcaatgccagcaagagaaggggtcaagtgcaaacacgggcatgccacagcacgggcaccggggagtggaatggcaccaccaagtgtgtgcgagccagcatcgccgcctggctgtttcagctacaacggcaggagtcatccaacgtaaccatgagctgatcaacactgcaatcatcgggcgggcgtgatgcaagcatgcctggcgaagacacatggtgtgcggatgctgccggctgctgcctgctgcgcacgccgttgagttggcagcaggctcagccatgcactggatggcagctgggctgccactgcaatgtggtggataggatgcaagtggagcgaataccaaaccctctggctgcttgctgggttgcatggcatcgcaccatcagcaggagcgcatgcgaagggactggccccatgcacgccatgccaaaccggagcgcaccgagtgtccacactgtcaccaggcccgcaagctttgcagaaccatgctcatggacgcatgtagcgctgacgtcccttgacggcgctcctctcgggtgtgggaaacgcaatgcagcacaggcagcagaggcggcggcagcagagcggcggcagcagcggcgggggccacccttcttgcggggtcgcgccccagccagcggtgatgcgctgatcccaaacgagttcacattcatttgcatgcctggagaagcgaggctggggcctttgggctggtgcagcccgcaatggaatgcgggaccgccaggctagcagcaaaggcgcctcccctactccgcatcgatgttccatagtgcattggactgcatttgggtggggcggccggctgtttctttcgtgttgcaaaacgcgccagctcagcaacctgtcccgtgggtcccccgtgccgatgaaatcgtgtgcacgccgatcagctgattgcccggctcgcgaagtaggcgccctcctttctgctcgccctctctccgtcccgcctctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggctatcaagacgaacaggcagcctgtggagaagcctccgttcacgatcgggacgctgcgcaaggccatccccgcgcactgtttcgagcgctcggcgcttcgtgggcgcgcccccgcgaacggcagcgcggtgaccctgaagtcgggctccctgaacacccaggaggacacgctgagctcgtccccccccccccgcgcgttcttcaaccagctgcccgactggagcatgctgctgaccgcgatcaccacggtcttcgtggcgcccgagaagcgctggaccatgttcgaccgcaagtcgaagcgccccaacatgctgatggactccttcggcctggagcgcgtggtccaggacggcctggtgttccgccagagcttctcgatccgctcctacgagatctgcgcggaccgcaccgcgagcatcgagacggtgatgaaccacgtccaggagacctcgctgaaccagtgcaagtccatcggcctgctggacgacggcttcggccgcagccccgagatgtgcaagcgcgacctgatctgggtggtcacccgcatgaagatcatggtgaaccgctaccccacgtggggcgacaccatcgaggtctcgacgtggctgtcccagagcggcaagatcggcatgggccgcgactggctgatctcggactgcaacaccggcgagatcctggtgcgcgcgacgtccgtctacgcgatgatgaaccagaagacccgccgcttcagcaagctgccccacgaggtgcgccaggagttcgcgccccacttcctggactcgccccccgcgatcgaggacaacgacggcaagctgcagaagttcgacgtcaagacgggcgactccatccgcaagggcctgacccccggctggtacgacctggacgtgaaccagcacgtgagcaacgtcaagtacatcggctggatcctggagtcgatgcccaccgaggtcctggagacgcaggagctgtgctccctgaccctggagtaccgccgcgagtgcggccgcgactcggtgctggagagcgtcaccagcatggacccctcgaaggtgggcgaccgcttccagtaccgccacctgctgcgcctggaggacggcgcggacatcatgaagggccgcaccgagtggcgccccaagaacgcgggcacgaacggcgcgatctccaccggcaagacgtgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctc

SEQ ID NO: 38 - protein, 408 aa, Artificial Sequence
  synthetic construct
MAIKTNRQPVEKPPFTIGTLRKAIPAHCFERSALRGRAPANGSAVNLKSGSLNTQEDTSSSPPPRAFLNQLPDWSMLLTAITTVFVAAEKQWTMLDRKSKRPDMLVDSVGLKSIVRDGLVSRQSFLIRSYEIGADRTASIETLMNHLQETSINHCKSLGLLNDGFGRTPGMCKNDLIWVLTKMQIMVNRYPTWGDTVEINTWFSQSGKIGMASDWLISDCNTGEILIRATSVWAMMNQKTRRFSRLPYEVRQELTPHFVDSPHVIEDNDQKLHKFDVKTGDSIRKGLTPRWNDLDVNQHVSNVKYIGWILESMPIEVLETQELCSLTVEYRRECGMDSVLESVTAVDPSENGGRSQYKHLLRLEDGTDIVKSRTEWRPKNAGTNGAISTSTAKTSNGNSASDDDDKLG

SEQ ID NO: 39 - DNA, 1239 bp, Artificial Sequence
  synthetic construct
actagtatggctatcaagacgaacaggcagcctgtggagaagcctccgttcacgatcgggacgctgcgcaaggccatccccgcgcactgtttcgagcgctcggcgcttcgtgggcgcgcccccgcgaacggcagcgcggtgaacctgaagtcgggctccctgaacacccaggaggacacgagctcgtccccccccccccgcgcgttcctgaaccagctgcccgactggagcatgctgctgaccgcgatcaccaccgtcttcgtggcggcggagaagcagtggacgatgctggaccgcaagtcgaagcgccccgacatgctggtggactccgtcggcctgaagagcatcgtgcgcgacggcctggtctcgcgccagtccttcctgatccgcagctacgagatcggcgcggaccgcaccgcgtcgatcgagaccctgatgaaccacctgcaggagacgtccatcaaccactgcaagagcctgggcctgctgaacgacggcttcggccgcacccccggcatgtgcaagaacgacctgatctgggtgctgaccaagatgcagatcatggtcaaccgctaccccacgtggggcgacaccgtcgagatcaacacgtggttctcgcagtccggcaagatcggcatggcgagcgactggctgatctcggactgcaacaccggcgagatcctgatccgcgcgacctccgtgtgggcgatgatgaaccagaagacgcgccgcttcagccgcctgccctacgaggtccgccaggagctgaccccccacttcgtggactcgccccacgtcatcgaggacaacgaccagaagctgcacaagttcgacgtgaagaccggcgactccatccgcaagggcctgacgccccgctggaacgacctggacgtcaaccagcacgtgtcgaacgtgaagtacatcggctggatcctggagtccatgcccatcgaggtcctggagacccaggagctgtgctcgctgaccgtggagtaccgccgcgagtgcggcatggactccgtgctggagtcggtcacggcggtggaccccagcgagaacggcggccgcagccagtacaagcacctgctgcgcctggaggacggcaccgacatcgtcaagtcgcgcaccgagtggcgccccaagaacgcgggcacgaacggcgcgatctccaccagcaccgcgaagacgtcgaacggcaactccgcgagcgatgacgatgacaagctgggatgactcgag

SEQ ID NO: 40 - protein, 399 aa, Artificial Sequence
  synthetic construct
MATASTFSAFNARCGDLRRSAGSGPRRPARPLPVRGRAAQAATRVNGSKVGLKTDTNKLEDAPFIPSSAPRTFYNQLPDWSVLLAAITTIFLAAEKQWTLIDWKRGGPDMLSDAFGLPKIIENGLLYRQKFSIRSYEIGADQTASIETLMNHLQETALNHVKCAGLLGNGFGSTPEMSKMNLIWVVTKMQVLVEHYPSWGDVIEVDTWAAASGKNGMRRDWHVRDWQTGQTIMRASSNWVMMNQNTRRLSKFPEEVRAEIEPYFMERAPVIDDDNRKLPKLDDDTADHVRNGLTPRWSDLDVNQHVKNVKYIGWILESAPISILESHELASMTLEYRRECGRDSVLQSLTSVSNNCTDGSEELPIECQHLLRNEGGSEIVKGRTEWRPKKCGPFGAGRP

SEQ ID NO: 41 - DNA, 1212 bp, Artificial Sequence
  synthetic construct
actagtatggccaccgcatccactttctcggcgttcaatgcccgctgcggcgacctgcgtcgctcggcgggctccgggccccggcgcccagcgaggcccctccccgtgcgcgggcgcgccgcccaggcggccacccgcgtgaacggcagcaaggtgggcctgaagaccgacaccaacaagctggaggacgcgcccttcatcccctcgtccgccccccgcaccttctacaaccagctgcccgactggagcgtcctgctggcggccatcaccaccatcttcctggcggccgagaagcagtggaccctgatcgactggaagcgcggcggccccgacatgctgtcggacgcgttcggcctgcccaagatcatcgagaacggcctgctgtaccgccagaagttctccatccgcagctacgagatcggcgccgaccagaccgcctcgatcgagaccctgatgaaccacctgcaggagaccgcgctgaaccacgtcaagtgcgccggcctgctgggcaacggcttcggctccacccccgagatgagcaagatgaacctgatctgggtggtcaccaagatgcaggtgctggtcgagcactacccctcgtggggcgacgtgatcgaggtggacacctgggcggccgcgtccggcaagaacggcatgcgccgcgactggcacgtccgcgactggcagaccggccagaccatcatgcgcgccagctcgaactgggtgatgatgaaccagaacacccgccgcctgtccaagttccccgaggaggtccgcgccgagatcgagccctacttcatggagcgcgcccccgtgatcgacgacgacaaccgcaagctgcccaagctggacgacgacaccgcggaccacgtgcgcaacggcctgaccccccgctggagcgacctggacgtgaaccagcacgtcaagaacgtgaagtacatcggctggatcctggagtcggcccccatctccatcctggagagccacgagctggcctcgatgaccctggagtaccgccgcgagtgcggccgcgactccgtcctgcagagcctgacctcggtgtccaacaactgcaccgacggcagcgaggagctgcccatcgagtgccagcacctgctgcgcaacgagggcggctcggagatcgtcaagggccgcaccgagtggcgccccaagaagtgcggccccttcggcgccggccgcccctgactcgag

SEQ ID NO: 42 - protein, 415 aa, Artificial Sequence
  synthetic construct
MAIKTNRQPVEKPPFTIGTLRKAIPAHCFERSALRGRAANAHTVPKINGNKAGLLTPMESTKDEDIVAAPTVAPKRTFINQLPDWSMLLAAITTIFLAAEKQWTNLDWKPRRPDMLVDFDPFSLGRFVQDGLIFRQNFSIRSYEIGADRTASIETLMNHLQETALNHVRCIGLLDDGFGSTPEMTRRDLIWVVTRMQVLVDRYPSWGDVIEVDSWVTPSGKNGMKREWFLRDCKTGEILTRATSVWVMMNKRTRRLSKIPEEVRVEIEPYFVEHGVLDEDSRKLPKLNDNTANYIRRGLAPRWSDLDVNQHVNNVKYIGWILESVPSSLLESHELYGMTLEYRKECGKDGLLQSLTAVASDYGGGSLEAGVECDHLLRLEDGSEIMRGKTEWRPKRAANTTYFGSVDDIPPANNA

SEQ ID NO: 43 - DNA, 1260 bp, Artificial Sequence
  synthetic construct
actagtatggctatcaagacgaacaggcagcctgtggagaagcctccgttcacgatcgggacgctgcgcaaggccatccccgcgcactgtttcgagcgctcggcgcttcgtgggcgcgccgccaacgcccacaccgtgcccaagatcaacggcaacaaggccggcctgctgacccccatggagagcaccaaggacgaggacatcgtcgcggcccccaccgtggcgcccaagcgcaccttcatcaaccagctgcccgactggtcgatgctgctggccgcgatcaccaccatcttcctggcggccgagaagcagtggaccaacctggactggaagccccgccgccccgacatgctggtcgacttcgaccccttctccctgggccgcttcgtgcaggacggcctgatcttccgccagaacttcagcatccgctcgtacgagatcggcgcggaccgcaccgcctccatcgagaccctgatgaaccacctgcaggagaccgcgctgaaccacgtccgctgcatcggcctgctggacgacggcttcggcagcacccccgagatgacccgccgcgacctgatctgggtggtcacccgcatgcaggtcctggtggaccgctacccctcgtggggcgacgtgatcgaggtcgactcctgggtgacccccagcggcaagaacggcatgaagcgcgagtggttcctgcgcgactgcaagaccggcgagatcctgacccgcgccacctcggtctgggtgatgatgaacaagcgcacccgccgcctgtccaagatccccgaggaggtccgcgtggagatcgagccctacttcgtcgagcacggcgtgctggacgaggactcgcgcaagctgcccaagctgaacgacaacaccgccaactacatccgccgcggcctggcgccccgctggtccgacctggacgtcaaccagcacgtgaacaacgtcaagtacatcggctggatcctggagagcgtgcccagcagcctgctggagtcgcacgagctgtacggcatgaccctggagtaccgcaaggagtgcggcaaggacggcctgctgcagtccctgaccgccgtcgccagcgactacggcggcggctcgctggaggccggcgtggagtgcgaccacctgctgcgcctggaggacggctccgagatcatgcgcggcaagaccgagtggcgccccaagcgcgccgcgaacaccacctacttcggcagcgtcgacgacatcccccccgccaacaacgcgtgactcgag

SEQ ID NO: 44 - protein, 362 aa, Artificial Sequence
  synthetic construct
MATASTFSAFNARCGDLRRSAGSGPRRPARPLPVRGRASMLLSAVTTVFGVAEKQWPMLDRKSKRPDMLVEPLGVDRIVYDGVSFRQSFSIRSYEIGADRTASIETLMNMFQETSLNHCKIIGLLNDGFGRTPEMCKRDLIWVVTKMQIEVNRYPTWGDTIEVNTWVSASGKHGMGRDWLISDCHTGEILIRATSVWAMMNQKTRRLSKIPYEVRQEIEPQFVDSAPVIVDDRKFHKLDLKTGDSICNGLTPRWTDLDVNQHVNNVKYIGWILQSVPTEVFETQELCGLTLEYRRECGRDSVLESVTAMDPSKEGDRSLYQHLLRLEDGADIVKGRTEWRPKNAGAKGAILTGKTSNGNSIS

SEQ ID NO: 45 - DNA, 1101 bp, Artificial Sequence
  synthetic construct
actagtatggccaccgcatccactttctcggcgttcaatgcccgctgcggcgacctgcgtcgctcggcgggctccgggccccggcgcccagcgaggcccctccccgtgcgcgggcgcgccagcatgctgctgtcggcggtgaccacggtcttcggcgtggccgagaagcagtggcccatgctggaccgcaagtccaagcgccccgacatgctggtcgagcccctgggcgtggaccgcatcgtctacgacggcgtgagcttccgccagtcgttctccatccgcagctacgagatcggcgccgaccgcaccgcctcgatcgagacgctgatgaacatgttccaggagacctccctgaaccactgcaagatcatcggcctgctgaacgacggcttcggccgcacgcccgagatgtgcaagcgcgacctgatctgggtcgtgaccaagatgcagatcgaggtgaaccgctaccccacgtggggcgacaccatcgaggtcaacacgtgggtgagcgcctcgggcaagcacggcatgggccgcgactggctgatctccgactgccacaccggcgagatcctgatccgcgcgacgagcgtctgggcgatgatgaaccagaagacccgccgcctgtcgaagatcccctacgaggtgcgccaggagatcgagccccagttcgtcgactccgcccccgtgatcgtggacgaccgcaagttccacaagctggacctgaagacgggcgacagcatctgcaacggcctgaccccccgctggacggacctggacgtgaaccagcacgtcaacaacgtgaagtacatcggctggatcctgcagtcggtccccaccgaggtgttcgagacgcaggagctgtgcggcctgaccctggagtaccgccgcgagtgcggccgcgactccgtgctggagagcgtcacggccatggacccctcgaaggagggcgaccgctccctgtaccagcacctgctgcgcctggaggacggcgcggacatcgtgaagggccgcaccgagtggcgccccaagaacgccggcgccaagggcgccatcctgacgggcaagaccagcaacggcaactcgatctcctgactcgag

SEQ ID NO: 46 - protein, 369 aa, Artificial Sequence
  synthetic construct
MATASTFSAFNARCGDLRRSAGSGPRRPARPLPVRGRAQLPDWSMLLAAITTLFLAAEKQWMMLDWKPKRPDMLVDPFGLGRFVQDGLVFRNNFSIRSYEIGADRTASIETLMNHLQETALNHVKSVGLLEDGLGSTREMSLRNLIWVVTKMQVAVDRYPTWGDEVQVSSWATAIGKNGMRREWIVTDFRTGETLLRATSVWVMMNKLTRRISKIPEEVWHEIGPSFIDAPPLPTVEDDGRKLTRFDESSADFIRKGLTPRWSDLDINQHVNNVKYIGWLLESAPPEIHESHEIASLTLEYRRECGRDSVLNSATKVSDSSQLGKSAVECNHLVRLQNGGEIVKGRTVWRPKRPLYNDGAVVDVPAKTS

SEQ ID NO: 47 - DNA, 1122 bp, Artificial Sequence
  synthetic construct
actagtatggccaccgcatccactttctcggcgttcaatgcccgctgcggcgacctgcgtcgctcggcgggctccgggccccggcgcccagcgaggcccctccccgtgcgcgggcgcgcccagctgcccgactggagcatgctgctggccgcgatcaccaccctgttcctggcggccgagaagcagtggatgatgctggactggaagcccaagcgccccgacatgctggtggaccccttcggcctgggccgcttcgtgcaggacggcctggtgttccgcaacaacttcagcatccgcagctacgagatcggcgcggaccgcaccgccagcatcgagaccctgatgaaccacctgcaggagaccgccctgaaccacgtgaagagcgtgggcctgctggaggacggcctgggcagcacccgcgagatgagcctgcgcaacctgatctgggtggtgaccaagatgcaggtggcggtggaccgctaccccacctggggcgacgaggtgcaggtgagcagctgggcgaccgccatcggcaagaacggcatgcgccgcgagtggatcgtgaccgacttccgcaccggcgagaccctgctgcgcgccaccagcgtgtgggtgatgatgaacaagctgacccgccgcatcagcaagatccccgaggaggtgtggcacgagatcggccccagcttcatcgacgcgccccccctgcccaccgtggaggacgacggccgcaagctgacccgcttcgacgagagcagcgccgacttcatccgcaagggcctgaccccccgctggagcgacctggacatcaaccagcacgtgaacaacgtgaagtacatcggctggctgctggagagcgcgccccccgagatccacgagagccacgagatcgccagcctgaccctggagtaccgccgcgagtgcggccgcgacagcgtgctgaacagcgccaccaaggtgagcgacagcagccagctgggcaagagcgccgtggagtgcaaccacctggtgcgcctgcagaacggcggcgagatcgtgaagggccgcaccgtgtggcgccccaagcgccccctgtacaacgacggcgccgtggtggacgtgcccgccaagaccagctgactcgag

SEQ ID NO: 48 - DNA, 120 bp, Artificial Sequence
  synthetic construct
actagtatggctatcaagacgaacaggcagcctgtggagaagcctccgttcacgatcgggacgctgcgcaaggccatccccgcgcactgtttcgagcgctcggcgcttcgtgggcgcgcc

SEQ ID NO: 49 - DNA, 120 bp, Artificial Sequence
  synthetic construct
actagtatggccaccgcatccactttctcggcgttcaatgcccgctgcggcgacctgcgtcgctcggcgggctccgggccccggcgcccagcgaggcccctccccgtgcgcgggcgcgcc

SEQ ID NO: 50 - DNA, 6207 bp, Artificial Sequence
  synthetic construct
gctcttcggccgccgccactcctgctcgagcgcgcccgactcgcgctccgcctgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccaccgcatccactttctcggcgttcaatgcccgctgcggcgacctgcgtcgctcggcgggctccgggccccggcgcccagcgaggcccctccccgtgcgcgggcgcgcccagctgcccgactggagcatgctgctggccgcgatcaccaccctgttcctggcggccgagaagcagtggatgatgctggactggaagcccaagcgccccgacatgctggtggaccccttcggcctgggccgcttcgtgcaggacggcctggtgttccgcaacaacttcagcatccgcagctacgagatcggcgcggaccgcaccgccagcatcgagaccctgatgaaccacctgcaggagaccgccctgaaccacgtgaagagcgtgggcctgctggaggacggcctgggcagcacccgcgagatgagcctgcgcaacctgatctgggtggtgaccaagatgcaggtggcggtggaccgctaccccacctggggcgacgaggtgcaggtgagcagctgggcgaccgccatcggcaagaacggcatgcgccgcgagtggatcgtgaccgacttccgcaccggcgagaccctgctgcgcgccaccagcgtgtgggtgatgatgaacaagctgacccgccgcatcagcaagatccccgaggaggtgtggcacgagatcggccccagcttcatcgacgcgccccccctgcccaccgtggaggacgacggccgcaagctgacccgcttcgacgagagcagcgccgacttcatccgcaagggcctgaccccccgctggagcgacctggacatcaaccagcacgtgaacaacgtgaagtacatcggctggctgctggagagcgcgccccccgagatccacgagagccacgagatcgccagcctgaccctggagtaccgccgcgagtgcggccgcgacagcgtgctgaacagcgccaccaaggtgagcgacagcagccagctgggcaagagcgccgtggagtgcaaccacctggtgcgcctgcagaacggcggcgagatcgtgaagggccgcaccgtgtggcgccccaagcgccccctgtacaacgacggcgccgtggtggacgtgcccgccaagaccagcgatgacgatgacaagctgggatgactcgagttaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctgtagagctccttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgttcgagcttgaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 51 - DNA, 5576 bp, Artificial Sequence
  synthetic construct
gaattcgccctcccgtgatcacacaggtgccttgcgagcgtgatcacactattttgggggtcctacagtactgaaatggtgagaagtcgtactgaaatcaaggatgaacaatgaaaatggtgctgtggtggcttctcaaaggtcaagaatcagtcgctcgcgtcaggaaatcgcggcgtcaaccagcgtgggcgcggtcagtggccccgcactggtcaccatagcctctcctgccacagtagcgatcccctgggcgttcactctcagcagcggctgtactgcctcccagattttcttcttctggacctgcgggcgtgagaggatgagcagggtgggccaagggctcaatcctgaacggccctcattcggtttccaatcccacaacacatacccacagcaggtcagaccacgcattccaccatgcgcaccaataacgtgtccttacctgattgggtgtggcaggctccgtggacaggagtgcctcgtcccccgcccagacccgctcccccgtcacggcggcgtccgggacccgcagcggctccaccgcggtgtgatccgcgttggcggcgcagagcagcatcccagccgatttgaccccgcgcatgctccgaggcttgaggttggccagcaccaccacccgccggccgacaaggtcctccagggtcacgtgccggaccaggccactcacgatggtgcgagggcccccctcctcgccgaggtcgatctgctcgacgtacagactgcgacatgcgtggcgagtggtcatcagaaggaagcaggtgtgcagaaggggcacgtggttggtattgagagtagccaaagctttgtgccaatcagaaagtcaacgcagctgcctgcctggctcgcgtacaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagcatattcaaacacctagatcactaccacttctacacaggccactcgagcttgtgatcgcactccgctaagggggcgcctcttcccttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgattaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatcccctccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatgacgttcggggtcgccctcccggccatgggccgcggtgtctcccttccccggcccagggtcgcggtgcgcgcccagtcggcgagtcaggttttggagagcgggcgcgcccccgactggtccatgctgttcgccgtgatcaccaccatcttctccgccgccgagaagcagtggaccaacctggagtggaagcccaagcccaaccccccccagctgctggacgaccacttcggcccccacggcctggtgttccgccgcaccttcgccatccgcagctacgaggtgggccccgaccgctccaccagcatcgtggccgtgatgaaccacctgcaggaggccgccctgaaccacgccaagtccgtgggcatcctgggcgacggcttcggcaccaccctggagatgtccaagcgcgacctgatctgggtggtgaagcgcacccacgtggccgtggagcgctaccccgcctggggcgacaccgtggaggtggagtgctgggtgggcgcctccggcaacaacggccgccgccacgacttcctggtgcgcgactgcaagaccggcgagatcctgacccgctgcacctccctgagcgtgatgatgaacacccgcacccgccgcctgagcaagatccccgaggaggtgcgcggcgagatcggccccgccttcatcgacaacgtggccgtgaaggacgaggagatcaagaagccccagaagctgaacgactccaccgccgactacatccagggcggcctgaccccccgctggaacgacctggacatcaaccagcacgtgaacaacatcaagtacgtggactggatcctggagaccgtgcccgacagcatcttcgagagccaccacatctcctccttcaccatcgagtaccgccgcgagtgcaccatggacagcgtgctgcagtccctgaccaccgtgagcggcggctcctccgaggccggcctggtgtgcgagcacctgctgcagctggagggcggcagcgaggtgctgcgcgccaagaccgagtggcgccccaagctgaccgactccttccgcggcatcagcgtgatccccgccgagtccagcgtgatggactacaaggaccacgacggcgactacaaggaccacgacatcgactacaaggacgacgacgacaagtgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctggtacccgtacccatcagcatccgggtgaatcttggcctccaagatatggccaatcctcacatccagcttggcaaaatcgactagactgtctgcaagtgggaatgtggagcacaaggttgcttgtagcgatcgacagactggtggggtacattgacaggtgggcagcgccgcatccatcgtgcctgacgcgagcgccgccggttgctcgcccgtgcctgccgtcaaagagcggcagagaaatcgggaaccgaaaacgtcacattgcctgatgttgttacatgctggactagactttcttggcgtgggtctgctcctcgccaggtgcgcgacgcctcggggctgggtgcgagggagccgtgcggccacgcatttgacaagacccaaagctcgcatctcagacggtcaaccgttcgtattatacattcaacatatggtacatacgcaaaaagcatgccaacgatgacataggcgaattc

SEQ ID NO: 52 - DNA, 4674 bp, Artificial Sequence
  synthetic construct
ggtacccgcctgcaacgcaagggcagccacagccgctcccacccgccgctgaaccgacacgtgcttgggcgcctgccgcctgcctgccgcatgcttgtgctggtgaggctgggcagtgctgccatgctgattgaggcttggttcatcgggtggaagcttatgtgtgtgctgggcttgcatgccgggcaatgcgcatggtggcaagagggcggcagcacttgctggagctgccgcggtgcctccaggtggttcaatcgcggcagccagagggatttcagatgatcgcgcgtacaggttgagcagcagtgtcagcaaaggtagcagtttgccagaatgatcggttcagctgttaatcaatgccagcaagagaaggggtcaagtgcaaacacgggcatgccacagcacgggcaccggggagtggaatggcaccaccaagtgtgtgcgagccagcatcgccgcctggctgtttcagctacaacggcaggagtcatccaacgtaaccatgagctgatcaacactgcaatcatcgggcgggcgtgatgcaagcatgcctggcgaagacacatggtgtgcggatgctgccggctgctgcctgctgcgcacgccgttgagttggcagcaggctcagccatgcactggatggcagctgggctgccactgcaatgtggtggataggatgcaagtggagcgaataccaaaccctctggctgcttgctgggttgcatggcatcgcaccatcagcaggagcgcatgcgaagggactggccccatgcacgccatgccaaaccggagcgcaccgagtgtccacactgtcaccaggcccgcaagctttgcagaaccatgctcatggacgcatgtagcgctgacgtcccttgacggcgctcctctcgggtgtgggaaacgcaatgcagcacaggcagcagaggcggcggcagcagagcggcggcagcagcggcgggggccacccttcttgcggggtcgcgccccagccagcggtgatgcgctgatcccaaacgagttcacattcatttgcatgcctggagaagcgaggctggggcctttgggctggtgcagcccgcaatggaatgcgggaccgccaggctagcagcaaaggcgcctcccctactccgcatcgatgttccatagtgcattggactgcatttgggtggggcggccggctgtttctttcgtgttgcaaaacgcgccagctcagcaacctgtcccgtgggtcccccgtgccgatgaaatcgtgtgcacgccgatcagctgattgcccggctcgcgaagtaggcgccctcctttctgctcgccctctctccgtcccgcctctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccaccgcatccactttctcggcgttcaatgcccgctgcggcgacctgcgtcgctcggcgggctccgggccccggcgcccagcgaggcccctccccgtgcgcgggcgcgcccagctgcccgactggagccgcctgctgaccgccatcaccaccgtgttcgtgaagtccaagcgccccgacatgcacgaccgcaagtccaagcgccccgacatgctggtggacagcttcggcctggagtccaccgtgcaggacggcctggtgttccgccagtccttctccatccgctcctacgagatcggcaccgaccgcaccgccagcatcgagaccctgatgaaccacctgcaggagacctccctgaaccactgcaagagcaccggcatcctgctggacggcttcggccgcaccctggagatgtgcaagcgcgacctgatctgggtggtgatcaagatgcagatcaaggtgaaccgctaccccgcctggggcgacaccgtggagatcaacacccgcttcagccgcctgggcaagatcggcatgggccgcgactggctgatctccgactgcaacaccggcgagatcctggtgcgcgccaccagcgcctacgccatgatgaaccagaagacccgccgcctgtccaagctgccctacgaggtgcaccaggagatcgtgcccctgttcgtggacagccccgtgatcgaggactccgacctgaaggtgcacaagttcaaggtgaagaccggcgacagcatccagaagggcctgacccccggctggaacgacctggacgtgaaccagcacgtgtccaacgtgaagtacatcggctggatcctggagagcatgcccaccgaggtgctggagacccaggagctgtgctccctggccctggagtaccgccgcgagtgcggccgcgactccgtgctggagagcgtgaccgccatggaccccagcaaggtgggcgtgcgctcccagtaccagcacctgctgcgcctggaggacggcaccgccatcgtgaacggcgccaccgagtggcgccccaagaacgccggcgccaacggcgccatctccaccggcaagaccagcaacggcaactccgtgtccatggactacaaggaccacgacggcgactacaaggaccacgacatcgactacaaggacgacgacgacaagtgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctc

SEQ ID NO: 53 - DNA, 4656 bp, Artificial Sequence
  synthetic construct
ggtacccgcctgcaacgcaagggcagccacagccgctcccacccgccgctgaaccgacacgtgcttgggcgcctgccgcctgcctgccgcatgcttgtgctggtgaggctgggcagtgctgccatgctgattgaggcttggttcatcgggtggaagcttatgtgtgtgctgggcttgcatgccgggcaatgcgcatggtggcaagagggcggcagcacttgctggagctgccgcggtgcctccaggtggttcaatcgcggcagccagagggatttcagatgatcgcgcgtacaggttgagcagcagtgtcagcaaaggtagcagtttgccagaatgatcggttcagctgttaatcaatgccagcaagagaaggggtcaagtgcaaacacgggcatgccacagcacgggcaccggggagtggaatggcaccaccaagtgtgtgcgagccagcatcgccgcctggctgtttcagctacaacggcaggagtcatccaacgtaaccatgagctgatcaacactgcaatcatcgggcgggcgtgatgcaagcatgcctggcgaagacacatggtgtgcggatgctgccggctgctgcctgctgcgcacgccgttgagttggcagcaggctcagccatgcactggatggcagctgggctgccactgcaatgtggtggataggatgcaagtggagcgaataccaaaccctctggctgcttgctgggttgcatggcatcgcaccatcagcaggagcgcatgcgaagggactggccccatgcacgccatgccaaaccggagcgcaccgagtgtccacactgtcaccaggcccgcaagctttgcagaaccatgctcatggacgcatgtagcgctgacgtcccttgacggcgctcctctcgggtgtgggaaacgcaatgcagcacaggcagcagaggcggcggcagcagagcggcggcagcagcggcgggggccacccttcttgcggggtcgcgccccagccagcggtgatgcgctgatcccaaacgagttcacattcatttgcatgcctggagaagcgaggctggggcctttgggctggtgcagcccgcaatggaatgcgggaccgccaggctagcagcaaaggcgcctcccctactccgcatcgatgttccatagtgcattggactgcatttgggtggggcggccggctgtttctttcgtgttgcaaaacgcgccagctcagcaacctgtcccgtgggtcccccgtgccgatgaaatcgtgtgcacgccgatcagctgattgcccggctcgcgaagtaggcgccctcctttctgctcgccctctctccgtcccgcctctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccaccgcatccactttctcggcgttcaatgcccgctgcggcgacctgcgtcgctcggcgggctccgggccccggcgcccagcgaggcccctccccgtgcgcgggcgcgcccccgactggtccatgctgttcgccgtgatcaccaccatcttcagcgccgccgagaagcagtggaccaacctggagtggaagcccaagcccaagctgccccagctgctggacgaccacttcggcctgcacggcctggtgttccgccgcaccttcgccatccgctcctacgaggtgggccccgaccgcagcacctccatcctggccgtgatgaaccacatgcaggaggccaccctgaaccacgccaagagcgtgggcatcctgggcgacggcttcggcaccaccctggagatgtccaagcgcgacctgatgtgggtggtgcgccgcacccacgtggccgtggagcgctaccccacctggggcgacaccgtggaggtggagtgctggatcggcgccagcggcaacaacggcatgcgccgcgacttcctggtgcgcgactgcaagaccggcgagatcctgacccgctgcacctccctgagcgtgctgatgaacacccgcacccgccgcctgagcaccatccccgacgaggtgcgcggcgagatcggccccgccttcatcgacaacgtggccgtgaaggacgacgagatcaagaagctgcagaagctgaacgactccaccgccgactacatccagggcggcctgaccccccgctggaacgacctggacgtgaaccagcacgtgaacaacctgaagtacgtggcctgggtgttcgagaccgtgcccgacagcatcttcgagtcccaccacatcagctccttcaccctggagtaccgccgcgagtgcacccgcgactccgtgctgcgcagcctgaccaccgtgagcggcggcagctccgaggccggcctggtgtgcgaccacctgctgcagctggagggcggcagcgaggtgctgcgcgcccgcaccgagtggcgccccaagctgaccgactccttccgcggcatcagcgtgatccccgccgagccccgcgtgatggactacaaggaccacgacggcgactacaaggaccacgacatcgactacaaggacgacgacgacaagtgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctc

SEQ ID NO: 54 - DNA, 4635 bp, Artificial Sequence
  synthetic construct
ggtacccgcctgcaacgcaagggcagccacagccgctcccacccgccgctgaaccgacacgtgcttgggcgcctgccgcctgcctgccgcatgcttgtgctggtgaggctgggcagtgctgccatgctgattgaggcttggttcatcgggtggaagcttatgtgtgtgctgggcttgcatgccgggcaatgcgcatggtggcaagagggcggcagcacttgctggagctgccgcggtgcctccaggtggttcaatcgcggcagccagagggatttcagatgatcgcgcgtacaggttgagcagcagtgtcagcaaaggtagcagtttgccagaatgatcggttcagctgttaatcaatgccagcaagagaaggggtcaagtgcaaacacgggcatgccacagcacgggcaccggggagtggaatggcaccaccaagtgtgtgcgagccagcatcgccgcctggctgtttcagctacaacggcaggagtcatccaacgtaaccatgagctgatcaacactgcaatcatcgggcgggcgtgatgcaagcatgcctggcgaagacacatggtgtgcggatgctgccggctgctgcctgctgcgcacgccgttgagttggcagcaggctcagccatgcactggatggcagctgggctgccactgcaatgtggtggataggatgcaagtggagcgaataccaaaccctctggctgcttgctgggttgcatggcatcgcaccatcagcaggagcgcatgcgaagggactggccccatgcacgccatgccaaaccggagcgcaccgagtgtccacactgtcaccaggcccgcaagctttgcagaaccatgctcatggacgcatgtagcgctgacgtcccttgacggcgctcctctcgggtgtgggaaacgcaatgcagcacaggcagcagaggcggcggcagcagagcggcggcagcagcggcgggggccacccttcttgcggggtcgcgccccagccagcggtgatgcgctgatcccaaacgagttcacattcatttgcatgcctggagaagcgaggctggggcctttgggctggtgcagcccgcaatggaatgcgggaccgccaggctagcagcaaaggcgcctcccctactccgcatcgatgttccatagtgcattggactgcatttgggtggggcggccggctgtttctttcgtgttgcaaaacgcgccagctcagcaacctgtcccgtgggtcccccgtgccgatgaaatcgtgtgcacgccgatcagctgattgcccggctcgcgaagtaggcgccctcctttctgctcgccctctctccgtcccgcctctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccaccgcatccactttctcggcgttcaatgcccgctgcggcgacctgcgtcgctcggcgggctccgggccccggcgcccagcgaggcccctccccgtgcgcgggcgcgcccagctgcccgactggagcatgctgctggccgcgatcaccaccctgttcctggcggccgagaagcagtggatgatgctggactggaagcccaagcgccccgacatgctggtggaccccttcggcctgggccgcttcgtgcaggacggcctggtgttccgcaacaacttcagcatccgcagctacgagatcggcgcggaccgcaccgccagcatcgagaccctgatgaaccacctgcaggagaccgccctgaaccacgtgaagagcgtgggcctgctggaggacggcctgggcagcacccgcgagatgagcctgcgcaacctgatctgggtggtgaccaagatgcaggtggcggtggaccgctaccccacctggggcgacgaggtgcaggtgagcagctgggcgaccgccatcggcaagaacggcatgcgccgcgagtggatcgtgaccgacttccgcaccggcgagaccctgctgcgcgccaccagcgtgtgggtgatgatgaacaagctgacccgccgcatcagcaagatccccgaggaggtgtggcacgagatcggccccagcttcatcgacgcgccccccctgcccaccgtggaggacgacggccgcaagctgacccgcttcgacgagagcagcgccgacttcatccgcaagggcctgaccccccgctggagcgacctggacatcaaccagcacgtgaacaacgtgaagtacatcggctggctgctggagagcgcgccccccgagatccacgagagccacgagatcgccagcctgaccctggagtaccgccgcgagtgcggccgcgacagcgtgctgaacagcgccaccaaggtgagcgacagcagccagctgggcaagagcgccgtggagtgcaaccacctggtgcgcctgcagaacggcggcgagatcgtgaagggccgcaccgtgtggcgccccaagcgccccctgtacaacgacggcgccgtggtggacgtgcccgccaagaccagcgatgacgatgacaagctgggatgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctc

SEQ ID NO: 55 - DNA, 997 bp, Prototheca moriformis
cctgtcgatcgaagagaaggagacatgtgtacattattggtgtgagggcgctgaatcggccattttttaaaatgatcacgctcatgccaatagacgcggcacataacgacgttcaaacccccgccaaagccgcggacaaccccatccctccacaccccccacacaaagaacccgccaccgcttaccttgcccacgaggtaggcctttcgttgcgcaaaaccggcctcggtgatgaatgcatgcccgttcctgacgagcgctgcccgggccaacacgctcttttgctgcgtctcctcaggcttgggggcctccttgggcttgggtgccgccatgatctgcgcgcatcagagaaacgttgctggtaaaaaggagcgcccggctgcgcaatatatatataggcatgccaacacagcccaacctcactcgggagcccgtcccaccacccccaagtcgcgtgccttgacggcatactgctgcagaagcttcatgagaatgatgccgaacaagaggggcacgaggacccaatcccggacatccttgtcgataatgatctcgtgagtccccatcgtccgcccgacgctccggggagcccgccgatgctcaagacgagagggccctcgaccaggaggggctggcccgggcgggcactggcgtcgaaggtgcgcccgtcgttcgcctgcagtcctatgccacaaaacaagtcttctgacggggtgcgtttgctcccgtgcgggcaggcaacagaggtattcaccctggtcatggggagatcggcgatcgagctgggataagagatacttctggcaagcaatgacaacttgtcaggaccggaccgtgccatatatttctcacctagcgccgcaaaacctaacaatttgggagtcactgtgccactgagttcgactggtagctgaatggagtcgctgctccactaaacgaattgtcagcaccgccagccggccgaggacccgagtcatagcgagggtagtagcgcgcc

SEQ ID NO: 56 - DNA, 753 bp, Prototheca moriformis
actaattgcaatcgtgcagtaatcatcgatatggtcacaagtagatcccctactgacaccctctcgtacatgtaggcaatgtcatcggcgccgtcctgctgaccgatgccgacgtagcagagcagacccgggccgatctgggatacgagccggccctccacctgcgctcgaggtggaatcaagtaaataaccaatacacttttcgacaccacacagagttgcacggacggtggcgtacctctacgctcgcgctcttcacgcgctggacgaccgcacgcatgagcccgggtggcttggtctgggctgcaaaaatgcacaacaaacaagtatcagacgctcatggatgcacacgcgctcccaagcacgctcagactaaatattacagtagctcgtatctgataagatatcgagacataccgctcaactcacccgcaaactgcgccccgccaggtgatgcgcacagggccccaccatgcgatccatcgcatcgctcctcgagggcgctatcacgtggccggagagcgttcacagcgtacgccactgtatctgggcggtatgcggtccgtcaacatggagacagatacccgcaccaccaccttgcaagctcttccatattggaagtagaaaattgtaattgtatcatcgcacgaggggccaacttgccgtcggcgagctgggcgacgaacaccacctggacgttgtcgagactcgctcgtgccgtgcgccgggccgctgggtatccagaccgtcgcc

SEQ ID NO: 57 - DNA, 1122 bp, Prototheca moriformis
caacgacaaccagcaggcaactcggtcagcgacccaacacgcgagtcaaattgttgcgtgttcttgccttgtctatttactgtgatagcaagactgtcggtcagtcaataccgcggtgcgcacgtcggggtgccaagcctagcagagcacgggacggctggtgctgtgcgccagctcagctcgcttcgcgaccaattgtaggaccggcaaagtcaccaaaacatgccagcggtgcgattcaattggtcatgagctctacaaaattgttttgtgcgtcgcgcaggtatccaacggcgcggcagagaaagtttgacagctctcgatttcatctcggaaaaatggggagaatttatgacacacaagtgcgcaggcggcccaggcggccagcatattctggcgtgacctgggccgcccacaaaatgcttggatgcactctaaaataattatatttgccatgaacaagggaagagttaccgcacccagccctagacttgggcgcccgagcaaggttacgtcaagccaccttcgcccatcgcccaactccgtattccccgacagccgcacgtggccctcgccggaatgaaccctgaatcggcatcacgccacgcgttcgccaatcgttccgctctctggcttcatcggcctgcgccttcacgtcgtggtcacgacagtgcattcatacttccatttgcacctcggcacacacttttacgcatcgcctacccttgctgcggcagtctagggtcactttgcagccatgggacagtgctacaccaccgtcggtgcgcaaagctatttcaagtgaaccgtgggcggaaaaaaggaatgtacactgtctcaaccgactcctacaattgtttaccatgcagatcagagctcgacggccatcatcgagcaggtgtggggccttggtggcgcggcgcggggccccagggcgtcgcaggcattgatggcactctgagactttcgcacgcgcatgagggaccccatcaagagaagagtgtgtctttatgtccccattcatgatgatgtatcttgtgattgtcgcagtttggcaagtttaaccggatcgccgctccaggtgtggcgtggcggatttttctaggggtgcttgagcagtcg

SEQ ID NO: 58 - DNA, 574 bp, Prototheca moriformis
ggcccagggccctgcggatggcccacaccagatctagcctctcttatgccatgcccgcctcgctgcccgtcgtatccccccgccgatccgcgcgtaggggaccgcggcctgacccacgccacgaaagagctttgctcctcaatttctcgccaacagaaccgtatcaaacgctcaacgcctatcccgaacaatccgtattcacaccaaatcgagtataccggactggtttgcctagtcttgaaggaaatgatcccgtccatgctcggaagggggagcgggcggaggatcctactcatctctgaaatgggattggtccgaagatgggttgggcaagcacgtgccaaaccccagcgagttgctgacgagcaggctcatccaatcccccggcgaatcctccctcacgccccgcatgcatacaagtccctcccacacgccccctcccatccattttcgcctggtccgaacgcgagcggcgtcgaggcggaccacttgctccgcagcgccgtctgggtctccaccccacagcggctttgctgccagaggcaccccccttgccccacctcctcttgcagcc

SEQ ID NO: 59 - DNA, 1096 bp, Prototheca moriformis
ccaggcaggcggtagggttgccgattgcttgagcgaattggaagatataattttttgtggtgtccctggacgctgtttgtggcgctcctttttggagaagattgcgtgggggagctttccatgtaccacgcttccttctgaaaggattctggccgagtcctgatgagcccaaagaaaacacctgcctttcagtgctggcactctgaaaacgtcaacagatgattatacatgtcacaaaaggcagccgattaggaacgggagctctggccgttcgtttggctgcctgggctgattgaagtgatccaccctgttcgaatgaaggcggtcgagtcgaattatcgaccggagctgtcgggaaggcgtccggggcagagtgaggtgctgcggcctggttgtcgttcaaaaagaccccggtagcccaacaatcacgaacgaaaggaatataattgcttgcatactatacattcagtttctatgtggcgggtagacaagtctcatgggcttctaaaggctgtcccttgaaggctacttataaaaacttgctgcgccatggcacggatcgcgcttgcgcaggctgcaaccctgcgcgcaaggtcaaatacacagcaaaagatactaacagaatttctaaaaacatttaaatatttgtttcgaccagccaattgtggtcgtaggcacgcaaaagactttgttttgcgcccaccgagcatccacgctggcagtcaagccagtccgatgtgcattgcgtggcagcatcgaggagcatcaaaaacctcgtgcacgcttttctgtcaatcatcatcaaccactccaccatgtatacccgatgcatcgcggtgcgcagcgcgccacgcgtcccagacccgcccaaaaacccagcagcggcgaaagcaaatcttcacttgcccgaaaccccgagcagcggcattcacacgtgggcgaaaaccccacttgccctaacaggcgtatgtctgctgtcacgatgcctgacaacggtattatagatatacactgattaatgtttgagtgtgtgcgagtcgcgaatcaggaatgaattgctagtaggcactccgaccgggcgggggccgagggacca

SEQ ID NO: 60 - DNA, 1075 bp, Prototheca moriformis
ggccgacaggacgcgcgtcaaaggtgctgggcgtgtatgccctggtcggcaggtcgttgctgttgctgcgctcgtggttccgcaaccctgattttggcgtcttattctggcgtggcaagcgctgacgcccgcgagccgggccggcggcgatgcggtgtctcacggctgccgagctccaagggaggcaagagcgcccggatcagctgaagggctttacacgcaaggtacagccgctcctgcaaggctgcgtggtggacttgaacctgtaggtcctctgctgaagttcctccactacctcaccaggcccagcagaccaaagcacaggcttttcaggtccgtgtcatccactctaaaacactcgactacgacctactgatggccctagattcttcatcaacaatgcctgagacacttgctcagaattgaaactccctgaagggaccaccagaggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgcggcgcctttcttgcgataatttatgcaatggactgctctgcaaatttctgggtctgtcgccaaccctaggatcagcggcgtaggatttcgtaatcattcgtcctgatggggagctaccgactaccctaatatcagcccggctgcctgacgccagcgtccacttttgcgtacacattccattcgtgcccaagacatttcattgtggtgcgaagcgtccccagttacgctcacctgtttcccgacctccttactgttctgtcgacagagcgggcccacaggccggtcgcagcc

SEQ ID NO: 61 - DNA, 772 bp, Prototheca moriformis
tcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcggggctggcgggaaaacaggcttcgtgtgctcaggttatgggaggtgcaggacagctcattaaacgccaacaatcgcacaattcatggcaagctaatcagttatttcccattaacgagctataattgtcccaaaattctggtctaccgggggtgatccttcgtgtacgggcccttccctcaaccctaggtatgcgcacatgcggtcgccgcgcaacgcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggtgtaggatttcgtaatcattcgtcctgatggggagctaccgactgccctagtatcagcccgactgcctgacgccagcgtccacttttgtgcacacattccattcgtgcccaagacatttcattgtggtgcgaagcgtccccagttacgctcacctgatccccaacctccttattgttctgtcgacagagtgggcccagaggccggtcgcagcc

SEQ ID NO: 62 - DNA, 991 bp, Prototheca moriformis
cgaaggggtctgcatcgattcgcgcggtctggaggccagcgtgactgctcgcgaaaatgctctgccgtgtcgggctctggctggggcggccagagatctcaccgtgccacacgcaactgccgcactctgtgcccgccacctggcgcgcacatgcgacctcttccccgtcataccctctcctcatgtgatctttccacacgagtgacgcaggtgcgcggagtggagggaatcaggacgttttcaaggtacctgctcgagccgtaccaacagctgccgcccggcaaggaagagatcgaggcagagattgcccggctggaggcccggataacggagctcaagagcaagctgtccgagtgagaccgcccaggtgcacgtgtcgactcgctatgacatgtactcgacacaacatgaggaattcatcgaatttgtaggaagcgggcattggtacgggagtgggaaagcgaaaaaacctccctccggcagtgccatctgccggagtcgaacgttgatagggttctcgtgacagggtgtgacctctcagccttgcatcaattaaacgctatagacattatcagtaaccgtgaatcccgcattggatgccacccgcgcgaccattggggacctgcattacagatctaggtgagatgacagcgaggcaacttcggcccgcggcccagcttgcggcgcaccaatattggtcacgggaagccacacaccgaccataaatgaatacttgtaagctatgtcaaccgatcaatggcgtcgaaagtgtgccacgaggatccatctggcggggcggcgtggcgcacaagcgcagtcgcaatttctcggacccatctgacctaggcccagcgccgcgggagaaatccccggcgggtcctccacgcagtaaccctaatgagtatcgagcgccgaccatttacaccatcgcccccgaaatccttccgacattattattatcttttagatcttggaacagactctgccaacc

SEQ ID NO: 63 - DNA, 1347 bp, Prototheca moriformis
agagagcggaggtggggttgtgaggtggggttgctgaccaggagctcgcgtcgccgagcgcgactcgcacacggtccagttacccccccctccgcccaaacgcaagcctcccatcttgatgcctttccggccacctatactatttcttagttcgctgtaacatccagaccgtcctgaataataacaatgccctgtgtcaagtgcattcctaaaaaaattctgtcccaaccaacaatcccacctgaaataccaccagccctgcccagtacactcttccaataccatctccctacctccacgcgcaagcgacccccatgcgcgaccaggctcgaaagtgatttatgacttgagacgagcgagtggcggcgcggtcgactgccttttcatcacgtgccgtacgtcggcgaccgctagggctttgcacggcaacgcacggcttcgccaacccgaccagccaggacctcgactactctaccgcgaattcgcctcaagaagtcgccaaatgtgccatacaccattccttacagcactgttcaaacttgatgccaattttgacattcgggttgctcgttggctgcgcccacatcggccgtgagtgcagcaggcgggatcggacacggaggacgcggcgtcacgccccgaacgcagcccgtaactctacatcaacacgacgtgttgcgtaatcccgcccggctgcgcatcgtgccaacccattcgcgatggatggtcggaaaatggtgtgccaactgccctgagggaggctctcgcgaaacgggcacgtccctgaaaccgaaactgtggccttgtcgtcggccacgcaagcacgtggaccctaaacaccaagaaaatcagtaaacaaggttgacatcctctacgggcgaattgtttgcccaacccttcatcgcacactgccattataatgcatctagctcggcgacaagtttagaaaaggcaggctgcattgttccatttcgccgtggcggcgtgggtgcccattttacgaggtttgggctcccgggcagcgaccgagccaggtcgagtccctctcgcccgtcgacaatgttgcgaaccccacaagcggctaacaacaacttgatggtacctgtacactgccaattccttcttccccggccgaggtttacacgtgatggccatggcttcgcattcaggccgacttcccattccgactttccagagggtccgcggacgctgggggttggctgcctgaggcccaccctttgttccccgcgtcccgacaaacacaattgcgttacataagggggagccgcccccgttcagagtgcagaaatctttcactatattttccagtcgtcagcgaaatcaagt

SEQ ID NO: 64 - DNA, 1180 bp, Prototheca moriformis
gatggtggggtgtctgccttgggctgggtgatggaggctggtggtgcgcgggtttcctgatgcattctatctacgcagtgtcatggtgtccattccacacaccagtacacccttacactaaggatccatccctccttccctcttcaggactacatggaccccacgagctaccgaccgggctttctcaaaaacgtcaaggtcatgtttgacatgcgggacgtggtggacgacgtgcaaggtgcgtccggagtgcgcgcaaatgagcaagtcgggcaatgtgtcggggtgggcaccggggctggagatccgcgatccccgagaaaacgccgtaccaccccccgcgctattccctcgattgcgcgcagatgtggtgaccgacacgggggacaacctggcggacatggggcgccggacctggaagcacgccaagtcgcacacggggaggctcgtgcagtcccccccatcgtacctcaagggtctctttggtcgcgatccaaagtacgctggtggcatggcatgcccgaaatgaacatcatgtgtgatctccgattgccaatggccacctccacggaccaccttgcaggcggaagcgcaatccagggcccgagcctgacgaggacggagactcctcgtccagcgcggggtccccgacccgacgcagcagccgacccctgctaacccggcaacgatcggaccagcaaccttgctgtagttccgatccgtgatgacgggcattgccgccgctcgatccgctttgatgactgtctattatttgcgcggagccccctcggaaccctaccccgctcttgcaagccccttgcatcggagatcctcgtgcgcccgccatgaccccactggattgcccaacatccttctttatcgtgtaaaatgtgattcctcggctgcaatcgactggccttcgcttctggccccaagagggctcgaacgtgcggcagcgagggcgctgacacacccaagccctagggctttcaacgtcggctgccaggccggatagggggatcgcctcctttccaccacccacctacgagggattcgagtcggcttccagctcagctattcggccgcgcccccggccctgcagacgtcctccagtttccgaacaggtcgctctcagaacacctgccgcggctgcgatacggcaggctctcaaagcgtcgac

SEQ ID NO: 65 - DNA, 1263 bp, Prototheca moriformis
cgcgtggagcggtgcgtgcggatgccgcgcgcctgccaaggccttttgtatgcctggcctgggaagtttcctgactgaagcatcttcaagatgctctctcacgaccagcgacaccaacaccgtcactttttgcccctcctgccgcaggtgccactttctactttgacgtcttctccaggcggtacattgcgggactgagcgccaattcggccaagaacagcgctgtcgacttgaggaggcaggggtccgtcgactctgccgagtgacacgccttcgacccgactgtactacggcctgctgaagagtgggtctcgccggccggcgtgaccggccctgtgcccacaatcgaccatctattcgctccttgtcatctggcgccgtcaattgcccgcgacttgacggcaactggctcgatcgagtcgtattgaaaaagcacgttttgtcctacagggccgcggtccgttaccaacgtggttctcgttaggttttcgtcgggcggtggtgcgcgaactgtccgatgccatcccggcaaaccccagcaaggtcgccagtctggttctgacgcaatagagtgcgttttgggccagtctaaaaattcgtctggcatgacgtggctccacatcgtacccggagcctgccttggtaatgtgaggcaccggtgccaactccattatggcaggcatcgagcgcgcaggtgagtacatgaccttccgtgaattgggaaggcgagcttgtgtaacgcctgcgatcgtgccagtgaggcatcgtaaactcaaaatattttgtagaaagtgtctgatgcctggtgaggctgcgtagggcaagggcaagcccttggcagatgggtaatgggtccggacctcacaacagcaaccccgcgtcccccttagggcccctgaggctcgatggcagggccagcgagcccgcggccaaagggcgccatcccacggtcgcccaacgactccacgggtcctatacctcatcttgaatggcactaaaaactatagaatatcgggcactggtgggcgtctggggtacagctggccgagcgcagtggcaaaccctaggtcccgcctcaagggcgattcccgggtcaatgacacgcaagcaagatcacatggcgcggtccgcctcgcggctccacacccaggccctagtttcgcaacccataaatatcgccccgataccatcataagccagcaaataattttttatcagagttccaaacctcctcagctgtgggaaaccagcccactctgaacg

SEQ ID NO: 66 - DNA, 1400 bp, Prototheca moriformis
ccgagcagttcatggccaagtacaaggactagagaccggaggtcggtaggctgaatggagctggcgtcgtcgtgcgcgacgtgcacgcgatgcgatactacgaccccacaaacgcatgcctcccatcttgatgcctttccggccatttatactatttctcatttcgctgtaacatcttgaataatagaattgccctgtgtcaagtggattccaagaaatattctgtcccaacaaaacaacccaacctgaaaacaacctcaaataccaccagccctgcccacctgcccagtacacttttccaataccatctccctaccttcacgcgcaagcggcacccatgcgcgaccaggctcgaaaggatttcacgactcaggacgagcgagtggcggcgcgaccgcctgcctgttcgtcacgtgccgtacgtcggcgaccgctagagctttgcctggcaacccccggcttcgtcaacccggccagccaggatctcgaccactctaccgcgaaatcgcctcaagaagtcgccaaaagtgccgtacaccatgcttcgcagcgctgttcaaacttgatgccaatcttgacaatcaggttgctcgttggctgcgtccacatcggccgtgattgcagcaggcggggatcggacacggaggacgcggcgtcacgccgcgaacgcagcccgtaactctacatcaacgcgatatgttgcgtaatcccgcccggctgcgcattgtgacaacccattcgcgatggatggtcggaaaatggtgtgccaactgccctgagggactctctcgcgaaacgggcacgtccctgtatccgaaactgtggcatggccttgtcgaccacgcaagcacgtggaccctaacaccacgaaaataagtaaaaaaggttgacatcctctacgagcgaattgtttgctcgacccttcatcgcacactgtcattataatgcatctagctcggcgacaagtttaaaaaaggcaggctgcattattccattttgccgtggcggcatgggtgcccattttatgaggtttgggctcttgggcagcgaccgagccaggttgagtccctctcgcccgtcgacaacgttccaaagcccataagtggctaataaacaacttgatggtacctgtacactgccagttccttcttccccggccgaggtttacacgtgatggccatggcttcgcgtttcaggctgacttcccattccgactttccagagggtccgcggacgccgggggttggctgcgtgaggcccaccccttgttccccgcgtcccgacaaacacaattgcgttacataagggggaagccgccccccgttcagagtgcaaacatctttcattatatttttcagtcgtcagcgaaatcaagtatgtcgctgacaggcatgaaggcc

SEQ ID NO: 67 - DNA, 6490 bp, Artificial Sequence
  synthetic construct
gctcttcggccgccgccactcctgctcgagcgcgcccgactcgcgctccgcctgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcatcgaatttgtaggaagcgggcattggtacgggagtgggaaagcgaaaaaacctccctccggcagtgccatctgccggagtcgaacgttgatagggttctcgtgacagggtgtgacctctcagccttgcatcaattaaacgctatagacattatcagtaaccgtgaatcccgcattggatgccacccgcgcgaccattggggacctgcattacagatctaggtgagatgacagcgaggcaacttcggcccgcggcccagcttgcggcgcaccaatattggtcacgggaagccacacaccgaccataaatgaatacttgtaagctatgtcaaccgatcaatggcgtcgaaagtgtgccacgaggatccatctggcggggcggcgtggcgcacaagcgcagtcgcaatttctcggacccatctgacctaggcccagcgccgcgggagaaatccccggcgggtcctccacgcagtaaccctaatgagtatcgagcgccgaccatttacaccatcgccccccgaaatccttccgacattattattatcttttagatcttggaacagactctgccaaccactagtatggccaccgcatccactttctcggcgttcaatgcccgctgcggcgacctgcgtcgctcggcgggctccgggccccggcgcccagcgaggcccctccccgtgcgcgggcgcgcccccgactggtccatgctgttcgccgtgatcaccaccatcttctccgccgccgagaagcagtggaccaacctggagtggaagcccaagcccaaccccccccagctgctggacgaccacttcggcccccacggcctggtgttccgccgcaccttcgccatccgcagctacgaggtgggccccgaccgctccaccagcatcgtggccgtgatgaaccacctgcaggaggccgccctgaaccacgccaagtccgtgggcatcctgggcgacggcttcggcaccaccctggagatgtccaagcgcgacctgatctgggtggtgaagcgcacccacgtggccgtggagcgctaccccgcctggggcgacaccgtggaggtggagtgctgggtgggcgcctccggcaacaacggccgccgccacgacttcctggtgcgcgactgcaagaccggcgagatcctgacccgctgcacctccctgagcgtgatgatgaacacccgcacccgccgcctgagcaagatccccgaggaggtgcgcggcgagatcggccccgccttcatcgacaacgtggccgtgaaggacgaggagatcaagaagccccagaagctgaacgactccaccgccgactacatccagggcggcctgaccccccgctggaacgacctggacatcaaccagcacgtgaacaacatcaagtacgtggactggatcctggagaccgtgcccgacagcatcttcgagagccaccacatctcctccttcaccatcgagtaccgccgcgagtgcaccatggacagcgtgctgcagtccctgaccaccgtgagcggcggctcctccgaggccggcctggtgtgcgagcacctgctgcagctggagggcggcagcgaggtgctgcgcgccaagaccgagtggcgccccaagctgaccgactccttccgcggcatcagcgtgatccccgccgagtccagcgtgatggactacaaggaccacgacggcgactacaaggaccacgacatcgactacaaggacgacgacgacaagtgactcgagttaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctgtagagctccttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgttcgagcttgaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 68 - DNA, 20 bp, Cinnamomum camphora
taccccgcctggggcgacac

SEQ ID NO: 69 - DNA, 20 bp, Cinnamomum camphora
cttgctcaggcggcgggtgc

SEQ ID NO: 70 - DNA, 20 bp, Prototheca moriformis
ccggatctcggccagggcta

SEQ ID NO: 71 - DNA, 20 bp, Prototheca moriformis
tcgatgtcgtgcaccgtcgc

SEQ ID NO: 72 - DNA, 1092 bp, Prototheca moriformis
gctcttcgggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcgccggtgcctacgtgggtcaagtatggcgtcatgtggccgctctactggttcttccaggtgtgtgtgagggttgtggttgcccgtatcgaggtcctggtggcgcgcatgggggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgccgccaccactccaacacggggtgcctggacaaggacgaggtgtttgtgccgccgcaccgcgcagtggcgcacgagggcctggagtgggaggagtggctgcccatccgcatgggcaaggtgctggtcaccctgaccctgggctggccgctgtacctcatgttcaacgtcgcctcgcggccgtacccgcgcttcgccaaccactttgacccgtggtcgcccatcttcagcaagcgcgaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgcc

SEQ ID NO: 73 - DNA, 1400 bp, Prototheca moriformis
caattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggagcatcgaggtggtcatctccgacctcgcgttggtggcggtgctcagcgggctcagcgtgctgggccgcaccatgggctgggcctggctggtcaagacctacgtggtgccctacatgatcgtgaacatgtggctggtgctcatcacgctgctccagcacacgcacccggccctgccgcactacttcgagaaggactgggactggctacgcggcgccatggccaccgtcgaccgctccatgggcccgcccttcatggacagcatcctgcaccacatctccgacacccacgtgctgcaccacctcttcagcaccatcccgcactaccacgccgaggaggcctccgccgccatccggcccatcctgggcaagtactaccaatccgacagccgctgggtcggccgcgccctgtgggaggactggcgcgactgccgctacgtcgtccccgacgcgcccgaggacgactccgcgctctggttccacaagtgagcgcgcctgcgcgaggacgcagaacaacgctgccgccgtgtcttttgcacgcgcgactccggcgcttcgctggtggcacccccataaagaaaccctcaattctgtttgtggaagacacggtgtacccccacccacccacctgcacctctattattggtattattgacgcgggagtgggcgttgtaccctacaacgtagcttctctagttttcagctggctcccaccattgtaaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 74 - DNA, 4091 bp, Prototheca moriformis
gctcttcgggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcgccggtgcctacgtgggtcaagtatggcgtcatgtggccgctctactggttcttccaggtgtgtgtgagggttgtggttgcccgtatcgaggtcctggtggcgcgcatgggggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgccgccaccactccaacacggggtgcctggacaaggacgaggtgtttgtgccgccgcaccgcgcagtggcgcacgagggcctggagtgggaggagtggctgcccatccgcatgggcaaggtgctggtcaccctgaccctgggctggccgctgtacctcatgttcaacgtcgcctcgcggccgtacccgcgcttcgccaaccactttgacccgtggtcgcccatcttcagcaagcgcgaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggagcatcgaggtggtcatctccgacctcgcgttggtggcggtgctcagcgggctcagcgtgctgggccgcaccatgggctgggcctggctggtcaagacctacgtggtgccctacatgatcgtgaacatgtggctggtgctcatcacgctgctccagcacacgcacccggccctgccgcactacttcgagaaggactgggactggctacgcggcgccatggccaccgtcgaccgctccatgggcccgcccttcatggacagcatcctgcaccacatctccgacacccacgtgctgcaccacctcttcagcaccatcccgcactaccacgccgaggaggcctccgccgccatccggcccatcctgggcaagtactaccaatccgacagccgctgggtcggccgcgccctgtgggaggactggcgcgactgccgctacgtcgtccccgacgcgcccgaggacgactccgcgctctggttccacaagtgagcgcgcctgcgcgaggacgcagaacaacgctgccgccgtgtcttttgcacgcgcgactccggcgcttcgctggtggcacccccataaagaaaccctcaattctgtttgtggaagacacggtgtacccccacccacccacctgcacctctattattggtattattgacgcgggagtgggcgttgtaccctacaacgtagcttctctagttttcagctggctcccaccattgtaaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 75 - DNA, 510 bp, Prototheca moriformis
gctcttccgcctggagctggtgcagagcatgggtcagtttgcggaggagagggtgctccccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgccaccaagtaggtacc

SEQ ID NO: 76 - DNA, 1186 bp, Prototheca moriformis
caattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaggatcgtagagctccagccacggcaacaccgcgcgcctggcggccgagcacggcgacaagggcctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgccgtcgccgagaagatcgacgtctacgacgccgaggactactgccgcatcctggagcacctcaacgcgcgctggaaggtggacgagcgccaggtcagcggccaggccgccgcggaccaggagtacgttctgggcctgccccagcgcttccggaaactcgccgagaagaccgccgccaagcgcaagcgcgtcgcgcgcaggcccgtcgccttctcctggagagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 77 - DNA, 3615 bp, Prototheca moriformis
gctcttccgcctggagctggtgcagagcatgggtcagtttgcggaggagagggtgctccccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgccaccaagtaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaggatcgtagagctccagccacggcaacaccgcgcgcctggcggccgagcacggcgacaagggcctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgccgtcgccgagaagatcgacgtctacgacgccgaggactactgccgcatcctggagcacctcaacgcgcgctggaaggtggacgagcgccaggtcagcggccaggccgccgcggaccaggagtacgttctgggcctgccccagcgcttccggaaactcgccgagaagaccgccgccaagcgcaagcgcgtcgcgcgcaggcccgtcgccttctcctggagagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 78 - DNA, 511 bp, Prototheca moriformis
gctcttcccgcctggagctggtgcagagcatggggcagtttgcggaggagagggtgctccccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgccaccaagtaggtacc

SEQ ID NO: 79 - DNA, 761 bp, Prototheca moriformis
cagccacggcaacaccgcgcgccttgcggccgagcacggcgacaagaacctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgcggtcgccgagaagatcgacgtctacgacgccgaggactactgccgcatcctggagcacctcaacgcgcgctggaaggtggacgagcgccaggtcagcggccaggccgccgcggaccaggagtacgtcctgggcctgccccagcgcttccggaaactcgccgagaagaccgccgccaagcgcaagcgcgtcgcgcgcaggcccgtcgccttctcctggagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 80 - DNA, 3599 bp, Prototheca moriformis
gctcttcccgcctggagctggtgcagagcatggggcagtttgcggaggagagggtgctccccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggctgaccacccgtgggcgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgccaccaagtaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggacagccacggcaacaccgcgcgccttgcggccgagcacggcgacaagaacctgagcaagatctgcgggctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgcggtcgccgagaagatcgacgtctacgacgccgaggactactgccgcatcctggagcacctcaacgcgcgctggaaggtggacgagcgccaggtcagcggccaggccgccgcggaccaggagtacgtcctgggcctgccccagcgcttccggaaactcgccgagaagaccgccgccaagcgcaagcgcgtcgcgcgcaggcccgtcgccttctcctggagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 81 - DNA, 2933 bp, Artificial Sequence
  synthetic construct
agagagcggaggtggggttgtgaggtggggttgctgaccaggagctcgcgtcgccgagcgcgactcgcacacggtccagttacccccccctccgcccaaacgcaagcctcccatcttgatgcctttccggccacctatactatttcttagttcgctgtaacatccagaccgtcctgaataataacaatgccctgtgtcaagtgcattcctaaaaaaattctgtcccaaccaacaatcccacctgaaataccaccagccctgcccagtacactcttccaataccatctccctacctccacgcgcaagcgacccccatgcgcgaccaggctcgaaagtgatttatgacttgagacgagcgagtggcggcgcggtcgactgccttttcatcacgtgccgtacgtcggcgaccgctagggctttgcacggcaacgcacggcttcgccaacccgaccagccaggacctcgactactctaccgcgaattcgcctcaagaagtcgccaaatgtgccatacaccattccttacagcactgttcaaacttgatgccaattttgacattcgggttgctcgttggctgcgcccacatcggccgtgagtgcagcaggcgggatcggacacggaggacgcggcgtcacgccccgaacgcagcccgtaactctacatcaacacgacgtgttgcgtaatcccgcccggctgcgcatcgtgccaacccattcgcgatggatggtcggaaaatggtgtgccaactgccctgagggaggctctcgcgaaacgggcacgtccctgaaaccgaaactgtggccttgtcgtcggccacgcaagcacgtggaccctaaacaccaagaaaatcagtaaacaaggttgacatcctctacgggcgaattgtttgcccaacccttcatcgcacactgccattataatgcatctagctcggcgacaagtttagaaaaggcaggctgcattgttccatttcgccgtggcggcgtgggtgcccattttacgaggtttgggctcccgggcagcgaccgagccaggtcgagtccctctcgcccgtcgacaatgttgcgaaccccacaagcggctaacaacaacttgatggtacctgtacactgccaattccttcttccccggccgaggtttacacgtgatggccatggcttcgcattcaggccgacttcccattccgactttccagagggtccgcggacgctgggggttggctgcctgaggcccaccctttgttccccgcgtcccgacaaacacaattgcgttacataagggggagccgcccccgttcagagtgcagaaatctttcactatattttccagtcgtcagcgaaatcaagtactagtatggccaccgcatccactttctcggcgttcaatgcccgctgcggcgacctgcgtcgctcggcgggctccgggccccggcgcccagcgaggcccctccccgtgcgcgggcgcgcccccgactggtccatgctgttcgccgtgatcaccaccatcttctccgccgccgagaagcagtggaccaacctggagtggaagcccaagcccaaccccccccagctgctggacgaccacttcggcccccacggcctggtgttccgccgcaccttcgccatccgcagctacgaggtgggccccgaccgctccaccagcatcgtggccgtgatgaaccacctgcaggaggccgccctgaaccacgccaagtccgtgggcatcctgggcgacggcttcggcaccaccctggagatgtccaagcgcgacctgatctgggtggtgaagcgcacccacgtggccgtggagcgctaccccgcctggggcgacaccgtggaggtggagtgctgggtgggcgcctccggcaacaacggccgccgccacgacttcctggtgcgcgactgcaagaccggcgagatcctgacccgctgcacctccctgagcgtgatgatgaacacccgcacccgccgcctgagcaagatccccgaggaggtgcgcggcgagatcggccccgccttcatcgacaacgtggccgtgaaggacgaggagatcaagaagccccagaagctgaacgactccaccgccgactacatccagggcggcctgaccccccgctggaacgacctggacatcaaccagcacgtgaacaacatcaagtacgtggactggatcctggagaccgtgcccgacagcatcttcgagagccaccacatctcctccttcaccatcgagtaccgccgcgagtgcaccatggacagcgtgctgcagtccctgaccaccgtgagcggcggctcctccgaggccggcctggtgtgcgagcacctgctgcagctggagggcggcagcgaggtgctgcgcgccaagaccgagtggcgccccaagctgaccgactccttccgcggcatcagcgtgatccccgccgagtccagcgtgatggactacaaggaccacgacggcgactacaaggaccacgacatcgactacaaggacgacgacgacaagtgactcgagttaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctt

SEQ ID NO: 82 - DNA, 726 bp, Artificial Sequence
  synthetic construct
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtacc

SEQ ID NO: 83 - DNA, 3635 bp, Artificial Sequence
  synthetic construct
ctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccaccgcatccactttctcggcgttcaatgcccgctgcggcgacctgcgtcgctcggcgggctccgggccccggcgcccagcgaggcccctccccgtgcgcgggcgcgcccccgactggtccatgctgttcgccgtgatcaccaccatcttctccgccgccgagaagcagtggaccaacctggagtggaagcccaagcccaaccccccccagctgctggacgaccacttcggcccccacggcctggtgttccgccgcaccttcgccatccgcagctacgaggtgggccccgaccgctccaccagcatcgtggccgtgatgaaccacctgcaggaggccgccctgaaccacgccaagtccgtgggcatcctgggcgacggcttcggcaccaccctggagatgtccaagcgcgacctgatctgggtggtgaagcgcacccacgtggccgtggagcgctaccccgcctggggcgacaccgtggaggtggagtgctgggtgggcgcctccggcaacaacggccgccgccacgacttcctggtgcgcgactgcaagaccggcgagatcctgacccgctgcacctccctgagcgtgatgatgaacacccgcacccgccgcctgagcaagatccccgaggaggtgcgcggcgagatcggccccgccttcatcgacaacgtggccgtgaaggacgaggagatcaagaagccccagaagctgaacgactccaccgccgactacatccagggcggcctgaccccccgctggaacgacctggacatcaaccagcacgtgaacaacatcaagtacgtggactggatcctggagaccgtgcccgacagcatcttcgagagccaccacatctcctccttcaccatcgagtaccgccgcgagtgcaccatggacagcgtgctgcagtccctgaccaccgtgagcggcggctcctccgaggccggcctggtgtgcgagcacctgctgcagctggagggcggcagcgaggtgctgcgcgccaagaccgagtggcgccccaagctgaccgactccttccgcggcatcagcgtgatccccgccgagtccagcgtgatggactacaaggaccacgacggcgactacaaggaccacgacatcgactacaaggacgacgacgacaagtgactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctt

SEQ ID NO: 84 - DNA, 749 bp, Artificial Sequence
  synthetic construct
gagctccttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 85 - DNA, 30 bp, Artificial Sequence
  synthesized primer
ggaggaattcggccgacaggacgcgcgtca

SEQ ID NO: 86 - DNA, 28 bp, Artificial Sequence
  synthesized primer
ggagactagtggctgcgaccggcctgtg

SEQ ID NO: 87 - DNA, 31 bp, Artificial Sequence
  synthesized primer
ggaggaattctcaccagcggacaaagcaccg

SEQ ID NO: 88 - DNA, 29 bp, Artificial Sequence
  synthesized primer
ggagactagtggctgcgaccggcctctgg

SEQ ID NO: 89 - DNA, 1065 bp, Artificial Sequence
  synthetic promoter
ggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagcc

SEQ ID NO: 90 - DNA, 6981 bp, Cinnamomum camphora
gctcttcggccgccgccactcctgctcgagcgcgcccgactcgcgctccgcctgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggccaccgcatccactttctcggcgttcaatgcccgctgcggcgacctgcgtcgctcggcgggctccgggccccggcgcccagcgaggcccctccccgtgcgcgggcgcgcccccgactggtccatgctgttcgccgtgatcaccaccatcttctccgccgccgagaagcagtggaccaacctggagtggaagcccaagcccaaccccccccagctgctggacgaccacttcggcccccacggcctggtgttccgccgcaccttcgccatccgcagctacgaggtgggccccgaccgctccaccagcatcgtggccgtgatgaaccacctgcaggaggccgccctgaaccacgccaagtccgtgggcatcctgggcgacggcttcggcaccaccctggagatgtccaagcgcgacctgatctgggtggtgaagcgcacccacgtggccgtggagcgctaccccgcctggggcgacaccgtggaggtggagtgctgggtgggcgcctccggcaacaacggccgccgccacgacttcctggtgcgcgactgcaagaccggcgagatcctgacccgctgcacctccctgagcgtgatgatgaacacccgcacccgccgcctgagcaagatccccgaggaggtgcgcggcgagatcggccccgccttcatcgacaacgtggccgtgaaggacgaggagatcaagaagccccagaagctgaacgactccaccgccgactacatccagggcggcctgaccccccgctggaacgacctggacatcaaccagcacgtgaacaacatcaagtacgtggactggatcctggagaccgtgcccgacagcatcttcgagagccaccacatctcctccttcaccatcgagtaccgccgcgagtgcaccatggacagcgtgctgcagtccctgaccaccgtgagcggcggctcctccgaggccggcctggtgtgcgagcacctgctgcagctggagggcggcagcgaggtgctgcgcgccaagaccgagtggcgccccaagctgaccgactccttccgcggcatcagcgtgatccccgccgagtccagcgtgatggactacaaggaccacgacggcgactacaaggaccacgacatcgactacaaggacgacgacgacaagtgactcgagttaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctgtagagctccttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgttcgagcttgaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttcc

SEQ ID NO: 91 - DNA, 1152 bp, Cinnamomum camphora
atggccaccgcatccactttctcggcgttcaatgcccgctgcggcgacctgcgtcgctcggcgggctccgggccccggcgcccagcgaggcccctccccgtgcgcgggcgcgcccccgactggtccatgctgttcgccgtgatcaccaccatcttctccgccgccgagaagcagtggaccaacctggagtggaagcccaagcccaaccccccccagctgctggacgaccacttcggcccccacggcctggtgttccgccgcaccttcgccatccgcagctacgaggtgggccccgaccgctccaccagcatcgtggccgtgatgaaccacctgcaggaggccgccctgaaccacgccaagtccgtgggcatcctgggcgacggcttcggcaccaccctggagatgtccaagcgcgacctgatctgggtggtgaagcgcacccacgtggccgtggagcgctaccccgcctggggcgacaccgtggaggtggagtgctgggtgggcgcctccggcaacaacggccgccgccacgacttcctggtgcgcgactgcaagaccggcgagatcctgacccgctgcacctccctgagcgtgatgatgaacacccgcacccgccgcctgagcaagatccccgaggaggtgcgcggcgagatcggccccgccttcatcgacaacgtggccgtgaaggacgaggagatcaagaagccccagaagctgaacgactccaccgccgactacatccagggcggcctgaccccccgctggaacgacctggacatcaaccagcacgtgaacaacatcaagtacgtggactggatcctggagaccgtgcccgacagcatcttcgagagccaccacatctcctccttcaccatcgagtaccgccgcgagtgcaccatggacagcgtgctgcagtccctgaccaccgtgagcggcggctcctccgaggccggcctggtgtgcgagcacctgctgcagctggagggcggcagcgaggtgctgcgcgccaagaccgagtggcgccccaagctgaccgactccttccgcggcatcagcgtgatccccgccgagtccagcgtgatggactacaaggaccacgacggcgactacaaggaccacgacatcgactacaaggacgacgacgacaagtga

SEQ ID NO: 92 - DNA, 1052 bp, Umbellularia californica
ggcgcgcccccgactggtccatgctgttcgccgtgatcaccaccatcttcagcgccgccgagaagcagtggaccaacctggagtggaagcccaagcccaagctgccccagctgctggacgaccacttcggcctgcacggcctggtgttccgccgcaccttcgccatccgctcctacgaggtgggccccgaccgcagcacctccatcctggccgtgatgaaccacatgcaggaggccaccctgaaccacgccaagagcgtgggcatcctgggcgacggcttcggcaccaccctggagatgtccaagcgcgacctgatgtgggtggtgcgccgcacccacgtggccgtggagcgctaccccacctggggcgacaccgtggaggtggagtgctggatcggcgccagcggcaacaacggcatgcgccgcgacttcctggtgcgcgactgcaagaccggcgagatcctgacccgctgcacctccctgagcgtgctgatgaacacccgcacccgccgcctgagcaccatccccgacgaggtgcgcggcgagatcggccccgccttcatcgacaacgtggccgtgaaggacgacgagatcaagaagctgcagaagctgaacgactccaccgccgactacatccagggcggcctgaccccccgctggaacgacctggacgtgaaccagcacgtgaacaacctgaagtacgtggcctgggtgttcgagaccgtgcccgacagcatcttcgagtcccaccacatcagctccttcaccctggagtaccgccgcgagtgcacccgcgactccgtgctgcgcagcctgaccaccgtgagcggcggcagctccgaggccggcctggtgtgcgaccacctgctgcagctggagggcggcagcgaggtgctgcgcgcccgcaccgagtggcgccccaagctgaccgactccttccgcggcatcagcgtgatccccgccgagccccgcgtgatggactacaaggaccacgacggcgactacaaggaccacgacatcgactacaaggacgacgacgacaagtgactcgag

SEQ ID NO: 93 - DNA, 1031 bp, Ulmus americana
ggcgcgcccagctgcccgactggagcatgctgctggccgcgatcaccaccctgttcctggcggccgagaagcagtggatgatgctggactggaagcccaagcgccccgacatgctggtggaccccttcggcctgggccgcttcgtgcaggacggcctggtgttccgcaacaacttcagcatccgcagctacgagatcggcgcggaccgcaccgccagcatcgagaccctgatgaaccacctgcaggagaccgccctgaaccacgtgaagagcgtgggcctgctggaggacggcctgggcagcacccgcgagatgagcctgcgcaacctgatctgggtggtgaccaagatgcaggtggcggtggaccgctaccccacctggggcgacgaggtgcaggtgagcagctgggcgaccgccatcggcaagaacggcatgcgccgcgagtggatcgtgaccgacttccgcaccggcgagaccctgctgcgcgccaccagcgtgtgggtgatgatgaacaagctgacccgccgcatcagcaagatccccgaggaggtgtggcacgagatcggccccagcttcatcgacgcgccccccctgcccaccgtggaggacgacggccgcaagctgacccgcttcgacgagagcagcgccgacttcatccgcaagggcctgaccccccgctggagcgacctggacatcaaccagcacgtgaacaacgtgaagtacatcggctggctgctggagagcgcgccccccgagatccacgagagccacgagatcgccagcctgaccctggagtaccgccgcgagtgcggccgcgacagcgtgctgaacagcgccaccaaggtgagcgacagcagccagctgggcaagagcgccgtggagtgcaaccacctggtgcgcctgcagaacggcggcgagatcgtgaagggccgcaccgtgtggcgccccaagcgccccctgtacaacgacggcgccgtggtggacgtgcccgccaagaccagcgatgacgatgacaagctgggatgactcgag

SEQ ID NO: 94 - DNA, 1182 bp, Cuphea hookeriana
actagtatggctatcaagacgaacaggcagcctgtggagaagcctccgttcacgatcgggacgctgcgcaaggccatccccgcgcactgtttcgagcgctcggcgcttcgtgggcgcgcccagctgcccgactggagccgcctgctgaccgccatcaccaccgtgttcgtgaagtccaagcgccccgacatgcacgaccgcaagtccaagcgccccgacatgctggtggacagcttcggcctggagtccaccgtgcaggacggcctggtgttccgccagtccttctccatccgctcctacgagatcggcaccgaccgcaccgccagcatcgagaccctgatgaaccacctgcaggagacctccctgaaccactgcaagagcaccggcatcctgctggacggcttcggccgcaccctggagatgtgcaagcgcgacctgatctgggtggtgattaagatgcagatcaaggtgaaccgctaccccgcctggggcgacaccgtggagatcaacacccgcttcagccgcctgggcaagatcggcatgggccgcgactggctgatctccgactgcaacaccggcgagatcctggtgcgcgccaccagcgcctacgccatgatgaaccagaagacccgccgcctgtccaagctgccctacgaggtgcaccaggagatcgtgcccctgttcgtggacagccccgtgatcgaggactccgacctgaaggtgcacaagttcaaggtgaagaccggcgacagcatccagaagggcctgacccccggctggaacgacctggacgtgaaccagcacgtgtccaacgtgaagtacatcggctggatcctggagagcatgcccaccgaggtgctggagacccaggagctgtgctccctggccctggagtaccgccgcgagtgcggccgcgactccgtgctggagagcgtgaccgccatggaccccagcaaggtgggcgtgcgctcccagtaccagcacctgctgcgcctggaggacggcaccgccatcgtgaacggcgccaccgagtggcgccccaagaacgccggcgccaacggcgccatctccaccggcaagaccagcaacggcaactccgtgtccatggactacaaggaccacgacggcgactacaaggaccacgacatcgactacaaggacgacgacgacaagtgactcgag

SEQ ID NO: 95 - DNA, 20 bp, Umbellularia californica
ctgggcgacggcttcggcac

SEQ ID NO: 96 - DNA, 20 bp, Umbellularia californica
aagtcgcggcgcatgccgtt

SEQ ID NO: 97 - DNA, 20 bp, Ulmus americana
cccagctgctcacctgcacc

SEQ ID NO: 98 - DNA, 26 bp, Ulmus americana
cacccaaggccaacggcagcgccgtg

SEQ ID NO: 99 - DNA, 20 bp, Cuphea hookeriana
taccccgcctggggcgacac

SEQ ID NO: 100 - DNA, 20 bp, Cuphea hookeriana
agcttggacaggcggcgggt

SEQ ID NO: 101 - DNA, 20 bp, Prototheca moriformis
tcacttcatgccggcggtcc

SEQ ID NO: 102 - DNA, 20 bp, Prototheca moriformis
gcgctcctgcttggctcgaa

SEQ ID NO: 103 - DNA, 733 bp, Artificial Sequence
  synthetic polynucleotide
gctcttcgagacgtggtctgaatcctccaggcgggtttccccgagaaagaaagggtgccgatttcaaagcagagccatgtgccgggccctgtggcctgtgttggcgcctatgtagtcaccccccctcacccaattgtcgccagtttgcgcaatccataaactcaaaactgcagcttctgagctgcgctgttcaagaacacctctggggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcgccggtgcctacgtgggtcaagtatggcgtcatgtggccgctctactggttcttccaggtgtgtgtgagggttgtggttgcccgtatcgaggtcctggtggcgcgcatgggggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgggtacc

SEQ ID NO: 104 - DNA, 739 bp, Artificial Sequence
  synthetic polynucleotide
ccgccaccactccaacacggggtgcctggacaaggacgaggtgtttgtgccgccgcaccgcgcagtggcgcacgagggcctggagtgggaggagtggctgcccatccgcatgggcaaggtgctggtcaccctgaccctgggctggccgctgtacctcatgttcaacgtcgcctcgcggccgtacccgcgcttcgccaaccactttgacccgtggtcgcccatcttcagcaagcgcgagcgcatcgaggtggtcatctccgacctggcgctggtggcggtgctcagcgggctcagcgtgctgggccgcaccatgggctgggcctggctggtcaagacctacgtggtgccctacctgatcgtgaacatgtggctcgtgctcatcacgctgctccagcacacgcacccggcgctgccgcactacttcgagaaggactgggactggctgcgcggcgccatggccaccgtggaccgctccatgggcccgcccttcatggacaacatcctgcaccacatctccgacacccacgtgctgcaccacctcttcagcaccatcccgcactaccacgccgaggaggcctccgccgccatcaggcccatcctgggcaagtactaccagtccgacagccgctgggtcggccgcgccctgtgggaggactggcgcgactgccgctacgtcgtcccggacgcgcccgaggacgactccgcgctctggttccacaagtgagtgagtgagaagagc

SEQ ID NO: 105 - DNA, 2327 bp, Saccharomyces cerevisiae
ctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatgga

SEQ ID NO: 106 - DNA, 735 bp, Artificial Sequence
  synthetic polynucleotide
gctcttcgaggggctggtctgaatccttcaggcgggtgttacccgagaaagaaagggtgccgatttcaaagcagacccatgtgccgggccctgtggcctgtgttggcgcctatgtagtcaccccccctcacccaattgtcgccagtttgcgcactccataaactcaaaacagcagcttctgagctgcgctgttcaagaacacctctggggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccaggtgtgtttgagggttttggttgcccgtattgaggtcctggtggcgcgcatggaggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgggtacc

SEQ ID NO: 107 - DNA, 739 bp, Artificial Sequence; identical to SEQ ID NO: 104
  synthetic polynucleotide

SEQ ID NO: 108 - protein, 471 aa, Saccharomyces carlbergensis
MFAFYFLTACISLKGVFGVSPSYNGLGLTPQMGWDNWNTFACDVSEQLLLDTADRISDLGLKDMGYKYIILDDCWSSGRDSDGFLVADEQKFPNGMGHVADHLHNNSFLFGMYSSAGEYTCAGYPGSLGREEEDAQFFANNRVDYLKYDNCYNKGQFGTPEISYHRYKAMSDALNKTGRPIFYSLCNWGQDLTFYWGSGIANSWRMSGDVTAEFTRPDSRCPCDGDEYDCKYAGFHCSIMNILNKAAPMGQNAGVGGWNDLDNLEVGVGNLTDDEEKAHFSMWAMVKSPLIIGANVNNLKASSYSIYSQASVIAINQDSNGIPATRVWRYYVSDTDEYGQGEIQMWSGPLDNGDQVVALLNGGSVSRPMNTTLEEIFFDSNLGSKKLTSTWDIYDLWANRVDNSTASAILGRNKTATGILYNATEQSYKDGLSKNDTRLFGQKIGSLSPNAILNTTVPAHGIAFYRLRPSS

SEQ ID NO: 109 - protein, 18 aa, Saccharomyces carlbergensis
MFAFYFLTACISLKGVFG

SEQ ID NO: 110 - DNA, 3183 bp, Saccharomyces carlbergensis
gcggccgcgtggacgagggctacaaccccgcctacggcgcgcgcccgctgcgccgcgccatcatgcgcctgctggaggacgcgctggccgagcgcatgctcgccggcgacgtcaaggagggcgactcggtcatcatggacgtcgatggcgatggcgccatcagcgtcctcaacggagaccgcacccacaccaccaccatcgactcctccccggcgggcatctcgtagacgcgagagggagggagggaggattttcagagggagatgagacgaggactgggccgggggccttggggcgctgctggagcgtggtgagagcgcggcggacgtgccttttcttcttccgtgcgcgcgctcttggccattgatccccgattcgcgcccgcatccccccactgcccccatcatcttgcctgttgtcgtggcactgacataaaccccctgcgctgcgctgctccgctactattgatataggtctcacgcgccaatcttttttgctccgggtaaccgtctggacgccagaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatgttcgcgttctacttcctgacggcctgcatctccctgaagggcgtgttcggcgtctccccctcctacaacggcctgggcctgacgccccagatgggctgggacaactggaacacgttcgcctgcgacgtctccgagcagctgctgctggacacggccgaccgcatctccgacctgggcctgaaggacatgggctacaagtacatcatcctggacgactgctggtcctccggccgcgactccgacggcttcctggtcgccgacgagcagaagttccccaacggcatgggccacgtcgccgaccacctgcacaacaactccttcctgttcggcatgtactcctccgcgggcgagtacacgtgcgccggctaccccggctccctgggccgcgaggaggaggacgcccagttcttcgcgaacaaccgcgtggactacctgaagtacgacaactgctacaacaagggccagttcggcacgcccgagatctcctaccaccgctacaaggccatgtccgacgccctgaacaagacgggccgccccatcttctactccctgtgcaactggggccaggacctgaccttctactggggctccggcatcgcgaactcctggcgcatgtccggcgacgtcacggcggagttcacgcgccccgactcccgctgcccctgcgacggcgacgagtacgactgcaagtacgccggcttccactgctccatcatgaacatcctgaacaaggccgcccccatgggccagaacgcgggcgtcggcggctggaacgacctggacaacctggaggtcggcgtcggcaacctgacggacgacgaggagaaggcgcacttctccatgtgggccatggtgaagtcccccctgatcatcggcgcgaacgtgaacaacctgaaggcctcctcctactccatctactcccaggcgtccgtcatcgccatcaaccaggactccaacggcatccccgccacgcgcgtctggcgctactacgtgtccgacacggacgagtacggccagggcgagatccagatgtggtccggccccctggacaacggcgaccaggtcgtggcgctgctgaacggcggctccgtgtcccgccccatgaacacgaccctggaggagatcttcttcgactccaacctgggctccaagaagctgacctccacctgggacatctacgacctgtgggcgaaccgcgtcgacaactccacggcgtccgccatcctgggccgcaacaagaccgccaccggcatcctgtacaacgccaccgagcagtcctacaaggacggcctgtccaagaacgacacccgcctgttcggccagaagatcggctccctgtcccccaacgcgatcctgaacacgaccgtccccgcccacggcatcgcgttctaccgcctgcgcccctcctcctgacaattgaagcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcagaatagtatcgggtgatgcgaagtcagaaccaggcagggcctgtcgcctgaggtggcaacgatgggaagcaatcaatctgggtacagtcgtccgcacgatcccgtgatctcccccaccgacacctatccccgcccatcccggcccaccctttcagtcccctcagcatgcattgtgcaccgcgacaaagcatgtctgctcgtgcactggttcaggccacggcgcaccgagtcctcgcccttcgcagagtgatcaccctccccggaaccagccacgctcgctgctgcgggccgatcagccgcgcgcactccctgcaactagggacaactcaggcaaccacgcgcctcacaagcatggccgccgtggcatccaacccgctcgtgacggtgggtgcgcaagtgccaggggcctcgtcgtcacggcgtgcatcctcgagggatgcgatccggcaactatatgtcgtttatctccccaccaatcacaggatgagcccctgtctaga

SEQ ID NO: 111 - DNA, 1416 bp, Saccharomyces carlbergensis
atgttcgcgttctacttcctgacggcctgcatctccctgaagggcgtgttcggcgtctccccctcctacaacggcctgggcctgacgccccagatgggctgggacaactggaacacgttcgcctgcgacgtctccgagcagctgctgctggacacggccgaccgcatctccgacctgggcctgaaggacatgggctacaagtacatcatcctggacgactgctggtcctccggccgcgactccgacggcttcctggtcgccgacgagcagaagttccccaacggcatgggccacgtcgccgaccacctgcacaacaactccttcctgttcggcatgtactcctccgcgggcgagtacacgtgcgccggctaccccggctccctgggccgcgaggaggaggacgcccagttcttcgcgaacaaccgcgtggactacctgaagtacgacaactgctacaacaagggccagttcggcacgcccgagatctcctaccaccgctacaaggccatgtccgacgccctgaacaagacgggccgccccatcttctactccctgtgcaactggggccaggacctgaccttctactggggctccggcatcgcgaactcctggcgcatgtccggcgacgtcacggcggagttcacgcgccccgactcccgctgcccctgcgacggcgacgagtacgactgcaagtacgccggcttccactgctccatcatgaacatcctgaacaaggccgcccccatgggccagaacgcgggcgtcggcggctggaacgacctggacaacctggaggtcggcgtcggcaacctgacggacgacgaggagaaggcgcacttctccatgtgggccatggtgaagtcccccctgatcatcggcgcgaacgtgaacaacctgaaggcctcctcctactccatctactcccaggcgtccgtcatcgccatcaaccaggactccaacggcatccccgccacgcgcgtctggcgctactacgtgtccgacacggacgagtacggccagggcgagatccagatgtggtccggccccctggacaacggcgaccaggtcgtggcgctgctgaacggcggctccgtgtcccgccccatgaacacgaccctggaggagatcttcttcgactccaacctgggctccaagaagctgacctccacctgggacatctacgacctgtgggcgaaccgcgtcgacaactccacggcgtccgccatcctgggccgcaacaagaccgccaccggcatcctgtacaacgccaccgagcagtcctacaaggacggcctgtccaagaacgacacccgcctgttcggccagaagatcggctccctgtcccccaacgcgatcctgaacacgaccgtccccgcccacggcatcgcgttctaccgcctgcgcccctcctcctga

SEQ ID NO: 112 - DNA, 526 bp, Artificial Sequence
  synthetic construct
gcggccgcgtggacgagggctacaaccccgcctacggcgcgcgcccgctgcgccgcgccatcatgcgcctgctggaggacgcgctggccgagcgcatgctcgccggcgacgtcaaggagggcgactcggtcatcatggacgtcgatggcgatggcgccatcagcgtcctcaacggagaccgcacccacaccaccaccatcgactcctccccggcgggcatctcgtagacgcgagagggagggagggaggattttcagagggagatgagacgaggactgggccgggggccttggggcgctgctggagcgtggtgagagcgcggcggacgtgccttttcttcttccgtgcgcgcgctcttggccattgatccccgattcgcgcccgcatccccccactgcccccatcatcttgcctgttgtcgtggcactgacataaaccccctgcgctgcgctgctccgctactattgatataggtctcacgcgccaatcttttttgctccgggtaaccgtctggacgccagaattc

SEQ ID NO: 113 - DNA, 507 bp, Artificial Sequence
  synthetic construct
gagctcagaatagtatcgggtgatgcgaagtcagaaccaggcagggcctgtcgcctgaggtggcaacgatgggaagcaatcaatctgggtacagtcgtccgcacgatcccgtgatctcccccaccgacacctatccccgcccatcccggcccaccctttcagtcccctcagcatgcattgtgcaccgcgacaaagcatgtctgctcgtgcactggttcaggccacggcgcaccgagtcctcgcccttcgcagagtgatcaccctccccggaaccagccacgctcgctgctgcgggccgatcagccgcgcgcactccctgcaactagggacaactcaggcaaccacgcgcctcacaagcatggccgccgtggcatccaacccgctcgtgacggtgggtgcgcaagtgccaggggcctcgtcgtcacggcgtgcatcctcgagggatgcgatccggcaactatatgtcgtttatctccccaccaatcacaggatgagcccctgtctaga

SEQ ID NO: 114 - DNA, 312 bp, Chlamydomonas reinhardtii
ctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaac

SEQ ID NO: 115 - DNA, 408 bp, Chlorella vulgaris
gcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctt

SEQ ID NO: 116 - protein, 747 aa, Aspergillus niger
MIGSSHAVVALGLFTLYGHSAAAPAIGASNSQTIVTNGTSFALNGDNVSYRFHVNSSTGDLISDHFGGVVSGTIPSPVEPAVNGWVGMPGRIRREFPDQGRGDFRIPAVRIRESAGYTVSDLQYVSHEVIEGKYALPGLPATFGDAQDATTLVVHLYDNYSSVAADLSYSIFPKYDAIVRSVNVTNQGPGNITIEALASISIDFPYEDLDMVSLRGDWAREANVQRSKVQYGVQGFGSSTGYSSHLHNPFLAIVDPATTESQGEAWGFNLVYTGSFSAQVEKGSQGFTRALLGFNPDQLSWNLGPGETLTSPECVAVYSDKGLGSVSRKFHRLYRNHLMKSKFATSDRPVLLNSWEGVYFDYNQSSIETLAEESAALGVHLFVMDDGWFGDKYPRVSDNAGLGDWMPNPARFPDGLTPVVQDITNLTVNGTESTKLRFGIWVEPEMVNPNSTLYHEHPEWALHAGPYPRTERRNQLVLNLALPAVQDFIIDFMTNLLQDTGISYVKWDNNRGIHETPSPSTDHQYMLGLYRVFDTLTTRFPDVLWEGCASGGGRFDAGMLQYVPQIWTSDNTDAIDRITIQFGTSLAYPPSAMGAHLSAVPNAQTGRTVPFTFRAHVAMMGGSFGLELDPATVEGDEIVPELLALAEKVNPIILNGDLYRLRLPQDSQWPAALFVSQDGAQAVLFYFQVQPNVNHAVPWVRLQGLDPKADYTVDGDQTYSGATLMNLGLQYSFDTEYGSKVVFLERQ

SEQ ID NO: 117 - protein, 28 aa, Aspergillus niger
MIGSSHAVVALGLFTLYGHSAAAPAIGA

SEQ ID NO: 118 - DNA, 2244 bp, Aspergillus niger
atgatcggctcctcccacgcggtcgtcgccctgggcctgttcaccctgtacggccactccgccgccgcgcccgccatcggcgcctccaactcccagaccatcgtcacgaacggcacctccttcgccctgaacggcgacaacgtgtcctaccgcttccacgtgaactcctccacgggcgacctgatctccgaccacttcggcggcgtggtgtccggcaccatcccctcccccgtggagcccgcggtcaacggctgggtgggcatgcccggccgcatccgccgcgagttccccgaccagggccgcggcgacttccgcatccccgcggtgcgcatccgcgagtccgccggctacaccgtctccgacctgcagtacgtgtcccacgaggtgatcgagggcaagtacgcgctgcccggcctgcccgccacgttcggcgacgcccaggacgccaccaccctggtggtgcacctgtacgacaactactcctccgtcgcggccgacctgtcctactccatcttccccaagtacgacgcgatcgtccgctccgtgaacgtgaccaaccagggccccggcaacatcaccatcgaggcgctggcctccatctccatcgacttcccctacgaggacctggacatggtgtccctgcgcggcgactgggcccgcgaggcgaacgtgcagcgctccaaggtccagtacggcgtgcagggcttcggctcctccaccggctactcctcccacctgcacaaccccttcctggcgatcgtcgaccccgcgaccaccgagtcccagggcgaggcctggggcttcaacctggtctacaccggctccttctccgcccaggtcgagaagggctcccagggcttcacgcgcgccctgctgggcttcaaccccgaccagctgtcctggaacctgggccccggcgagacgctgacgtcccccgagtgcgtcgccgtctactccgacaagggcctgggctccgtctcccgcaagttccaccgcctgtaccgcaaccacctgatgaagtccaagttcgccacgtccgaccgccccgtgctgctgaactcctgggagggcgtctacttcgactacaaccagtcctccatcgagacgctggcggaggagtccgccgccctgggcgtgcacctgttcgtcatggacgacggctggttcggcgacaagtacccccgcgtgtccgacaacgccggcctgggcgactggatgcccaaccccgcccgcttccccgacggcctgacgcccgtcgtgcaggacatcaccaacctgaccgtcaacggcaccgagtccaccaagctgcgcttcggcatctgggtggagcccgagatggtgaaccccaactccaccctgtaccacgagcaccccgagtgggcgctgcacgcgggcccctacccccgcaccgagcgccgcaaccagctggtcctgaacctggccctgcccgcggtccaggacttcatcatcgacttcatgaccaacctgctgcaggacaccggcatctcctacgtcaagtgggacaacaaccgcggcatccacgagacgccctccccctccacggaccaccagtacatgctgggcctgtaccgcgtgttcgacacgctgaccacgcgcttccccgacgtcctgtgggagggctgcgcgtccggcggcggccggttcgacgccggcatgctgcagtacgtcccccagatctggacgtccgacaacacggacgcgatcgaccgcatcaccatccagttcggcacctccctggcctaccccccctccgccatgggcgcccacctgtccgcggtgcccaacgcccagaccggccgcacggtgcccttcaccttccgcgcccacgtcgcgatgatgggcggctccttcggcctggagctggaccccgccaccgtggagggcgacgagatcgtgcccgagctgctggcgctggccgagaaggtgaaccccatcatcctgaacggcgacctgtaccgcctgcgcctgccccaggactcccagtggcccgcggccctgttcgtgtcccaggacggcgcccaggccgtcctgttctacttccaggtgcagcccaacgtcaaccacgccgtcccctgggtccgcctgcagggcctggaccccaaggccgactacacggtggacggcgaccagacgtactccggcgcgaccctgatgaacctgggcctgcagtactccttcgacaccgagtacggctccaaggtggtgttcctggagcgccagtaa

SEQ ID NO: 119 - DNA, 4011 bp, Aspergillus niger
gcggccgcgtggacgagggctacaaccccgcctacggcgcgcgcccgctgcgccgcgccatcatgcgcctgctggaggacgcgctggccgagcgcatgctcgccggcgacgtcaaggagggcgactcggtcatcatggacgtcgatggcgatggcgccatcagcgtcctcaacggagaccgcacccacaccaccaccatcgactcctccccggcgggcatctcgtagacgcgagagggagggagggaggattttcagagggagatgagacgaggactgggccgggggccttggggcgctgctggagcgtggtgagagcgcggcggacgtgccttttcttcttccgtgcgcgcgctcttggccattgatccccgattcgcgcccgcatccccccactgcccccatcatcttgcctgttgtcgtggcactgacataaaccccctgcgctgcgctgctccgctactattgatataggtctcacgcgccaatcttttttgctccgggtaaccgtctggacgccagaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatgatcggctcctcccacgcggtcgtcgccctgggcctgttcaccctgtacggccactccgccgccgcgcccgccatcggcgcctccaactcccagaccatcgtcacgaacggcacctccttcgccctgaacggcgacaacgtgtcctaccgcttccacgtgaactcctccacgggcgacctgatctccgaccacttcggcggcgtggtgtccggcaccatcccctcccccgtggagcccgcggtcaacggctgggtgggcatgcccggccgcatccgccgcgagttccccgaccagggccgcggcgacttccgcatccccgcggtgcgcatccgcgagtccgccggctacaccgtctccgacctgcagtacgtgtcccacgaggtgatcgagggcaagtacgcgctgcccggcctgcccgccacgttcggcgacgcccaggacgccaccaccctggtggtgcacctgtacgacaactactcctccgtcgcggccgacctgtcctactccatcttccccaagtacgacgcgatcgtccgctccgtgaacgtgaccaaccagggccccggcaacatcaccatcgaggcgctggcctccatctccatcgacttcccctacgaggacctggacatggtgtccctgcgcggcgactgggcccgcgaggcgaacgtgcagcgctccaaggtccagtacggcgtgcagggcttcggctcctccaccggctactcctcccacctgcacaaccccttcctggcgatcgtcgaccccgcgaccaccgagtcccagggcgaggcctggggcttcaacctggtctacaccggctccttctccgcccaggtcgagaagggctcccagggcttcacgcgcgccctgctgggcttcaaccccgaccagctgtcctggaacctgggccccggcgagacgctgacgtcccccgagtgcgtcgccgtctactccgacaagggcctgggctccgtctcccgcaagttccaccgcctgtaccgcaaccacctgatgaagtccaagttcgccacgtccgaccgccccgtgctgctgaactcctgggagggcgtctacttcgactacaaccagtcctccatcgagacgctggcggaggagtccgccgccctgggcgtgcacctgttcgtcatggacgacggctggttcggcgacaagtacccccgcgtgtccgacaacgccggcctgggcgactggatgcccaaccccgcccgcttccccgacggcctgacgcccgtcgtgcaggacatcaccaacctgaccgtcaacggcaccgagtccaccaagctgcgcttcggcatctgggtggagcccgagatggtgaaccccaactccaccctgtaccacgagcaccccgagtgggcgctgcacgcgggcccctacccccgcaccgagcgccgcaaccagctggtcctgaacctggccctgcccgcggtccaggacttcatcatcgacttcatgaccaacctgctgcaggacaccggcatctcctacgtcaagtgggacaacaaccgcggcatccacgagacgccctccccctccacggaccaccagtacatgctgggcctgtaccgcgtgttcgacacgctgaccacgcgcttccccgacgtcctgtgggagggctgcgcgtccggcggcggccggttcgacgccggcatgctgcagtacgtcccccagatctggacgtccgacaacacggacgcgatcgaccgcatcaccatccagttcggcacctccctggcctaccccccctccgccatgggcgcccacctgtccgcggtgcccaacgcccagaccggccgcacggtgcccttcaccttccgcgcccacgtcgcgatgatgggcggctccttcggcctggagctggaccccgccaccgtggagggcgacgagatcgtgcccgagctgctggcgctggccgagaaggtgaaccccatcatcctgaacggcgacctgtaccgcctgcgcctgccccaggactcccagtggcccgcggccctgttcgtgtcccaggacggcgcccaggccgtcctgttctacttccaggtgcagcccaacgtcaaccacgccgtcccctgggtccgcctgcagggcctggaccccaaggccgactacacggtggacggcgaccagacgtactccggcgcgaccctgatgaacctgggcctgcagtactccttcgacaccgagtacggctccaaggtggtgttcctggagcgccagtaacaattgaagcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcagaatagtatcgggtgatgcgaagtcagaaccaggcagggcctgtcgcctgaggtggcaacgatgggaagcaatcaatctgggtacagtcgtccgcacgatcccgtgatctcccccaccgacacctatccccgcccatcccggcccaccctttcagtcccctcagcatgcattgtgcaccgcgacaaagcatgtctgctcgtgcactggttcaggccacggcgcaccgagtcctcgcccttcgcagagtgatcaccctccccggaaccagccacgctcgctgctgcgggccgatcagccgcgcgcactccctgcaactagggacaactcaggcaaccacgcgcctcacaagcatggccgccgtggcatccaacccgctcgtgacggtgggtgcgcaagtgccaggggcctcgtcgtcacggcgtgcatcctcgagggatgcgatccggcaactatatgtcgtttatctccccaccaatcacaggatgagcccctgtctaga

SEQ ID NO: 120 - protein, 411 aa, Cyamopsis tetragonoloba
MATHYSIIGGMIIVVLLMIIGSEGGRLLEKKNRTSAEAEHYNVRRYLAENGLGQTPPMGWNSWNHFGCDINENVVRETADAMVSTGLAALGYQYINLDDCWAELNRDSEGNMVPNAAAFPSGIKALADYVHSKGLKLGVYSDAGNQTCSKRMPGSLGHEEQDAKTFASWGVDYLKYDNCENLGISVKERYPPMGKALLSSGRPIFFSMCEWGWEDPQIWAKSIGNSWRTTGDIEDNWNSMTSIADSNDKWASYAGPGGWNDPDMLEVGNGGMTTEEYRSHFSIWALAKAPLLVGCDIRAMDDTTHELISNAEVIAVNQDKLGVQGKKVKSTNDLEVWAGPLSDNKVAVILWNRSSSRATVTASWSDIGLQQGTTVDARDLWEHSTQSLVSGEISAEIDSHACKMYVLTPRS

SEQ ID NO: 121 - DNA, 1236 bp, Cyamopsis tetragonoloba
atggccacccactactccatcatcggcggcatgatcatcgtcgtcctgctgatgatcatcggctccgagggcggccggctgctggagaagaagaaccgcacctccgccgaggcggagcactacaacgtgcgccgctacctggccgagaacggcctgggccagaccccccccatgggctggaactcctggaaccacttcggctgcgacatcaacgagaacgtcgtccgcgagacggcggacgccatggtgtccaccggcctggccgccctgggctaccagtacatcaacctggacgactgctgggcggagctgaaccgcgactccgagggcaacatggtgcccaacgccgccgcgttcccctccggcatcaaggcgctggcggactacgtccactccaagggcctgaagctgggcgtctactccgacgcgggcaaccagacctgctccaagcgcatgcccggctccctgggccacgaggagcaggacgcgaagacgttcgcctcctggggcgtcgactacctgaagtacgacaactgcgagaacctgggcatctccgtgaaggagcgctacccccccatgggcaaggcgctgctgtcctccggccgccccatcttcttctccatgtgcgagtggggctgggaggacccccagatctgggccaagtccatcggcaactcctggcgcaccaccggcgacatcgaggacaactggaactccatgacctccatcgccgactccaacgacaagtgggcctcctacgccggccccggcggctggaacgaccccgacatgctggaggtcggcaacggcggcatgacgacggaggagtaccgctcccacttctccatctgggccctggccaaggcgcccctgctggtgggctgcgacatccgcgcgatggacgacacgacgcacgagctgatctccaacgccgaggtgatcgcggtgaaccaggacaagctgggcgtgcagggcaagaaggtcaagtccacgaacgacctggaggtctgggccggccccctgtccgacaacaaggtggcggtgatcctgtggaaccgctcctcctcccgcgccaccgtcaccgcgtcctggtccgacatcggcctgcagcagggcaccaccgtcgacgcgcgcgacctgtgggagcactccacgcagtccctggtgtccggcgagatctccgccgagatcgactcccacgcctgcaagatgtacgtcctgacgccccgctcctaa

SEQ ID NO: 122 - DNA, 3003 bp, Cyamopsis tetragonoloba
gcggccgcgtggacgagggctacaaccccgcctacggcgcgcgcccgctgcgccgcgccatcatgcgcctgctggaggacgcgctggccgagcgcatgctcgccggcgacgtcaaggagggcgactcggtcatcatggacgtcgatggcgatggcgccatcagcgtcctcaacggagaccgcacccacaccaccaccatcgactcctccccggcgggcatctcgtagacgcgagagggagggagggaggattttcagagggagatgagacgaggactgggccgggggccttggggcgctgctggagcgtggtgagagcgcggcggacgtgccttttcttcttccgtgcgcgcgctcttggccattgatccccgattcgcgcccgcatccccccactgcccccatcatcttgcctgttgtcgtggcactgacataaaccccctgcgctgcgctgctccgctactattgatataggtctcacgcgccaatcttttttgctccgggtaaccgtctggacgccagaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccacccactactccatcatcggcggcatgatcatcgtcgtcctgctgatgatcatcggctccgagggcggccggctgctggagaagaagaaccgcacctccgccgaggcggagcactacaacgtgcgccgctacctggccgagaacggcctgggccagaccccccccatgggctggaactcctggaaccacttcggctgcgacatcaacgagaacgtcgtccgcgagacggcggacgccatggtgtccaccggcctggccgccctgggctaccagtacatcaacctggacgactgctgggcggagctgaaccgcgactccgagggcaacatggtgcccaacgccgccgcgttcccctccggcatcaaggcgctggcggactacgtccactccaagggcctgaagctgggcgtctactccgacgcgggcaaccagacctgctccaagcgcatgcccggctccctgggccacgaggagcaggacgcgaagacgttcgcctcctggggcgtcgactacctgaagtacgacaactgcgagaacctgggcatctccgtgaaggagcgctacccccccatgggcaaggcgctgctgtcctccggccgccccatcttcttctccatgtgcgagtggggctgggaggacccccagatctgggccaagtccatcggcaactcctggcgcaccaccggcgacatcgaggacaactggaactccatgacctccatcgccgactccaacgacaagtgggcctcctacgccggccccggcggctggaacgaccccgacatgctggaggtcggcaacggcggcatgacgacggaggagtaccgctcccacttctccatctgggccctggccaaggcgcccctgctggtgggctgcgacatccgcgcgatggacgacacgacgcacgagctgatctccaacgccgaggtgatcgcggtgaaccaggacaagctgggcgtgcagggcaagaaggtcaagtccacgaacgacctggaggtctgggccggccccctgtccgacaacaaggtggcggtgatcctgtggaaccgctcctcctcccgcgccaccgtcaccgcgtcctggtccgacatcggcctgcagcagggcaccaccgtcgacgcgcgcgacctgtgggagcactccacgcagtccctggtgtccggcgagatctccgccgagatcgactcccacgcctgcaagatgtacgtcctgacgccccgctcctaacaattgaagcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcagaatagtatcgggtgatgcgaagtcagaaccaggcagggcctgtcgcctgaggtggcaacgatgggaagcaatcaatctgggtacagtcgtccgcacgatcccgtgatctcccccaccgacacctatccccgcccatcccggcccaccctttcagtcccctcagcatgcattgtgcaccgcgacaaagcatgtctgctcgtgcactggttcaggccacggcgcaccgagtcctcgcccttcgcagagtgatcaccctccccggaaccagccacgctcgctgctgcgggccgatcagccgcgcgcactccctgcaactagggacaactcaggcaaccacgcgcctcacaagcatggccgccgtggcatccaacccgctcgtgacggtgggtgcgcaagtgccaggggcctcgtcgtcacggcgtgcatcctcgagggatgcgatccggcaactatatgtcgtttatctccccaccaatcacaggatgagcccctgtctaga

SEQ ID NO: 123 - DNA, 22 bp, Chlorella vulgaris
actgcaatgctgatgcacggga

SEQ ID NO: 124 - DNA, 19 bp, Chlorella vulgaris
tccaggtccttttcgcact

SEQ ID NO: 125 - protein, 632 aa, Unknown
  Coccomyxa species
MTTNLAKLPLGGLSSRSSIAGAPLRVNSHSRERHLGAKTTAIAAPERLDYLDNAEEARLQQTDAFAELKALSSRQSVNRPQKGELSFRQSPTFQDCFPGSEKCYREVEHDGKTLKVPFRRVHLQDDNGHFDLYDTSGPQGVNPREGLPKIRSSWVEPREARGDKVQTQQYYAKQGIITEEMAFCAARERMDPEFIRSEVARGRAIIPANKRHLELEPTVVGRNFLVKVNANIGNSAVSSSIEEEVEKLQWSTIWGADTAMDLSTGNNIHETREWVMRNSPVPVGTVPIYQCLEKAGGIVENITWELFRETLIEQAEQGVDYFTIHAGVLLRYIPLTANRVTGIVSRGGSIHAKLCLLDHTENFAYMHWDEILDICAQYDITLSIGDGLRPGCIADANDAAQFAELKTQGELTRRAWAKDVQVMNEGPGHVPLHKIPENMEKQLDWCSEAPFYTLGPLATDIAPAYDHITSAIGAATIGALGTALLCYVTPKEHLGLPDRDDVKAGVIAYKIAAHAADLAKGHPYAQEWDNALSKARFEFRWYDQFHLSLDPVTARLFHDATLPQEPAKTAHFCSMCGPKFCSMQITQDLREYAKNHQMEEDEAIQTGMAEMSEQFKSIGAEVYLDEAVLEHA

SEQ ID NO: 126 - protein, 40 aa, Unknown
  Coccomyxa species
MTTNLAKLPLGGLSSRSSIAGAPLRVNSHSRERHLGAKTT

SEQ ID NO: 127 - DNA, 6649 bp, Unknown
  Coccomyxa species
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatgaccaccaacctggctaagctgcctctcggcggcctctcttctcggtcgtccatcgccggggctcctctgcgcgtgaacagccacagccgcgagcgccacctgggcgccaagaccaccgcgatcgccgctcccgagcggctggactacctcgacaacgcggaggaggcgcggctgcagcagacggacgccttcgccgagctgaaggcgctgtcgagccgccagtccgtgaaccggccccaaaagggcgagctgtcgttccggcagtcgccgacctttcaggactgcttccctggctcggagaagtgctaccgcgaggtggagcacgatggcaagacgctcaaggtgccttttcgccgggtgcacctgcaggacgacaacggccatttcgacctgtacgacacctctggcccccagggcgtgaacccccgcgagggtctgcccaagatccgctcctcctgggtggagccgcgcgaggcgcggggcgacaaggtgcaaacgcagcagtactacgccaagcaaggcatcatcaccgaggagatggccttctgcgctgcgcgcgagcgcatggaccccgagttcatccggtctgaggtggcccggggtcgggccatcatccctgcgaacaagcgccatctggagctggagccgaccgtcgtgggccgcaactttctggtcaaggtgaacgccaacatcggcaactctgcggtcagctcgagcatcgaggaggaggtggagaagctgcagtggagcaccatctggggtgccgacacggccatggacctgagcaccggcaacaacatccacgagacgcgcgagtgggtgatgcgcaacagcccggtccctgtgggtacggtccctatctaccagtgcctggagaaggcgggcggcatcgtggagaacatcacctgggagctgttccgggagacgctgatcgagcaggccgagcagggcgtcgactactttaccatccacgcgggggtcctgctccgctacatccccctgacggcgaaccgcgtcaccggcatcgtcagccgcggcggctctatccatgccaagctctgcctgctggaccacaccgagaacttcgcctacatgcactgggacgagatcctggacatctgcgcccagtacgacatcaccctgtcgatcggcgacggcctgcgccccggctgcatcgcggacgccaacgacgctgcccagtttgctgagctgaagacccagggcgagctgacccgccgcgcctgggcgaaggacgtgcaggtgatgaacgagggtcccggccatgtgccgctgcacaagatccccgagaacatggagaagcagctggactggtgcagcgaggcgcccttctacacgctcggccccctggcgacggacatcgcgcctgcgtacgaccacatcacctccgcgatcggcgccgccacgatcggcgcgctggggaccgcgctgctgtgttacgtgaccccgaaggagcacctgggcctccccgatcgcgacgacgtgaaggccggggtgatcgcctacaagatcgcggcgcacgcggctgacctggcgaagggtcacccctacgctcaggagtgggataacgccctctctaaggcgcgcttcgagttccggtggtacgaccagttccacctgtcgctggaccccgtcaccgcccgcctgttccatgacgcgaccctgccgcaggagcccgccaagaccgcccacttctgctccatgtgcggccccaagttctgctccatgcagatcacccaggacctccgcgagtacgccaagaaccatcaaatggaggaggacgaggcgatccaaaccggcatggccgagatgtccgagcagttcaagagcatcggcgcggaggtctacctcgacgaggcggtgctggagcacgcgtaagcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagctgaagagc

SEQ ID NO: 128 - DNA, 1899 bp, Unknown
  Coccomyxa species
atgaccaccaacctggctaagctgcctctcggcggcctctcttctcggtcgtccatcgccggggctcctctgcgcgtgaacagccacagccgcgagcgccacctgggcgccaagaccaccgcgatcgccgctcccgagcggctggactacctcgacaacgcggaggaggcgcggctgcagcagacggacgccttcgccgagctgaaggcgctgtcgagccgccagtccgtgaaccggccccaaaagggcgagctgtcgttccggcagtcgccgacctttcaggactgcttccctggctcggagaagtgctaccgcgaggtggagcacgatggcaagacgctcaaggtgccttttcgccgggtgcacctgcaggacgacaacggccatttcgacctgtacgacacctctggcccccagggcgtgaacccccgcgagggtctgcccaagatccgctcctcctgggtggagccgcgcgaggcgcggggcgacaaggtgcaaacgcagcagtactacgccaagcaaggcatcatcaccgaggagatggccttctgcgctgcgcgcgagcgcatggaccccgagttcatccggtctgaggtggcccggggtcgggccatcatccctgcgaacaagcgccatctggagctggagccgaccgtcgtgggccgcaactttctggtcaaggtgaacgccaacatcggcaactctgcggtcagctcgagcatcgaggaggaggtggagaagctgcagtggagcaccatctggggtgccgacacggccatggacctgagcaccggcaacaacatccacgagacgcgcgagtgggtgatgcgcaacagcccggtccctgtgggtacggtccctatctaccagtgcctggagaaggcgggcggcatcgtggagaacatcacctgggagctgttccgggagacgctgatcgagcaggccgagcagggcgtcgactactttaccatccacgcgggggtcctgctccgctacatccccctgacggcgaaccgcgtcaccggcatcgtcagccgcggcggctctatccatgccaagctctgcctgctggaccacaccgagaacttcgcctacatgcactgggacgagatcctggacatctgcgcccagtacgacatcaccctgtcgatcggcgacggcctgcgccccggctgcatcgcggacgccaacgacgctgcccagtttgctgagctgaagacccagggcgagctgacccgccgcgcctgggcgaaggacgtgcaggtgatgaacgagggtcccggccatgtgccgctgcacaagatccccgagaacatggagaagcagctggactggtgcagcgaggcgcccttctacacgctcggccccctggcgacggacatcgcgcctgcgtacgaccacatcacctccgcgatcggcgccgccacgatcggcgcgctggggaccgcgctgctgtgttacgtgaccccgaaggagcacctgggcctccccgatcgcgacgacgtgaaggccggggtgatcgcctacaagatcgcggcgcacgcggctgacctggcgaagggtcacccctacgctcaggagtgggataacgccctctctaaggcgcgcttcgagttccggtggtacgaccagttccacctgtcgctggaccccgtcaccgcccgcctgttccatgacgcgaccctgccgcaggagcccgccaagaccgcccacttctgctccatgtgcggccccaagttctgctccatgcagatcacccaggacctccgcgagtacgccaagaaccatcaaatggaggaggacgaggcgatccaaaccggcatggccgagatgtccgagcagttcaagagcatcggcgcggaggtctacctcgacgaggcggtgctggagcacgcgtaa

SEQ ID NO: 129 - DNA, 1613 bp, Saccharomyces cerevisiae
ggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattg

SEQ ID NO: 130 - DNA, 3660 bp, Artificial Sequence
  synthetic nucleotide
gcggccgcgtggacgagggctacaaccccgcctacggcgcgcgcccgctgcgccgcgccatcatgcgcctgctggaggacgcgctggccgagcgcatgctcgccggcgacgtcaaggagggcgactcggtcatcatggacgtcgatggcgatggcgccatcagcgtcctcaacggagaccgcacccacaccaccaccatcgactcctccccggcgggcatctcgtagacgcgagagggagggagggaggattttcagagggagatgagacgaggactgggccgggggccttggggcgctgctggagcgtggtgagagcgcggcggacgtgccttttcttcttccgtgcgcgcgctcttggccattgatccccgattcgcgcccgcatccccccactgcccccatcatcttgcctgttgtcgtggcactgacataaaccccctgcgctgcgctgctccgctactattgatataggtctcacgcgccaatcttttttgctccgggtaaccgtctggacgccagaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggccaccgcatccactttctcggcgttcaatgcccgctgcggcgacctgcgtcgctcggcgggctccgggccccggcgcccagcgaggcccctccccgtgcgcgggcgcgccgcgatcgccgctcccgagcggctggactacctcgacaacgcggaggaggcgcggctgcagcagacggacgccttcgccgagctgaaggcgctgtcgagccgccagtccgtgaaccggccccaaaagggcgagctgtcgttccggcagtcgccgacctttcaggactgcttccctggctcggagaagtgctaccgcgaggtggagcacgatggcaagacgctcaaggtgccttttcgccgggtgcacctgcaggacgacaacggccatttcgacctgtacgacacctctggcccccagggcgtgaacccccgcgagggtctgcccaagatccgctcctcctgggtggagccgcgcgaggcgcggggcgacaaggtgcaaacgcagcagtactacgccaagcaaggcatcatcaccgaggagatggccttctgcgctgcgcgcgagcgcatggaccccgagttcatccggtctgaggtggcccggggtcgggccatcatccctgcgaacaagcgccatctggagctggagccgaccgtcgtgggccgcaactttctggtcaaggtgaacgccaacatcggcaactctgcggtcagctcgagcatcgaggaggaggtggagaagctgcagtggagcaccatctggggtgccgacacggccatggacctgagcaccggcaacaacatccacgagacgcgcgagtgggtgatgcgcaacagcccggtccctgtgggtacggtccctatctaccagtgcctggagaaggcgggcggcatcgtggagaacatcacctgggagctgttccgggagacgctgatcgagcaggccgagcagggcgtcgactactttaccatccacgcgggggtcctgctccgctacatccccctgacggcgaaccgcgtcaccggcatcgtcagccgcggcggctctatccatgccaagctctgcctgctggaccacaccgagaacttcgcctacatgcactgggacgagatcctggacatctgcgcccagtacgacatcaccctgtcgatcggcgacggcctgcgccccggctgcatcgcggacgccaacgacgctgcccagtttgctgagctgaagacccagggcgagctgacccgccgcgcctgggcgaaggacgtgcaggtgatgaacgagggtcccggccatgtgccgctgcacaagatccccgagaacatggagaagcagctggactggtgcagcgaggcgcccttctacacgctcggccccctggcgacggacatcgcgcctgcgtacgaccacatcacctccgcgatcggcgccgccacgatcggcgcgctggggaccgcgctgctgtgttacgtgaccccgaaggagcacctgggcctccccgatcgcgacgacgtgaaggccggggtgatcgcctacaagatcgcggcgcacgcggctgacctggcgaagggtcacccctacgctcaggagtgggataacgccctctctaaggcgcgcttcgagttccggtggtacgaccagttccacctgtcgctggaccccgtcaccgcccgcctgttccatgacgcgaccctgccgcaggagcccgccaagaccgcccacttctgctccatgtgcggccccaagttctgctccatgcagatcacccaggacctccgcgagtacgccaagaaccatcaaatggaggaggacgaggcgatccaaaccggcatggccgagatgtccgagcagttcaagagcatcggcgcggaggtctacctcgacgaggcggtgctggagcacgcgtaacaattgaagcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcagaatagtatcgggtgatgcgaagtcagaaccaggcagggcctgtcgcctgaggtggcaacgatgggaagcaatcaatctgggtacagtcgtccgcacgatcccgtgatctcccccaccgacacctatccccgcccatcccggcccaccctttcagtcccctcagcatgcattgtgcaccgcgacaaagcatgtctgctcgtgcactggttcaggccacggcgcaccgagtcctcgcccttcgcagagtgatcaccctccccggaaccagccacgctcgctgctgcgggccgatcagccgcgcgcactccctgcaactagggacaactcaggcaaccacgcgcctcacaagcatggccgccgtggcatccaacccgctcgtgacggtgggtgcgcaagtgccaggggcctcgtcgtcacggcgtgcatcctcgagggatgcgatccggcaactatatgtcgtttatctccccaccaatcacaggatgagcccctgtctaga

SEQ ID NO: 131 - DNA, 1905 bp, Artificial Sequence
  synthetic nucleotide
actagtatggccaccgcatccactttctcggcgttcaatgcccgctgcggcgacctgcgtcgctcggcgggctccgggccccggcgcccagcgaggcccctccccgtgcgcgggcgcgccgcgatcgccgctcccgagcggctggactacctcgacaacgcggaggaggcgcggctgcagcagacggacgccttcgccgagctgaaggcgctgtcgagccgccagtccgtgaaccggccccaaaagggcgagctgtcgttccggcagtcgccgacctttcaggactgcttccctggctcggagaagtgctaccgcgaggtggagcacgatggcaagacgctcaaggtgccttttcgccgggtgcacctgcaggacgacaacggccatttcgacctgtacgacacctctggcccccagggcgtgaacccccgcgagggtctgcccaagatccgctcctcctgggtggagccgcgcgaggcgcggggcgacaaggtgcaaacgcagcagtactacgccaagcaaggcatcatcaccgaggagatggccttctgcgctgcgcgcgagcgcatggaccccgagttcatccggtctgaggtggcccggggtcgggccatcatccctgcgaacaagcgccatctggagctggagccgaccgtcgtgggccgcaactttctggtcaaggtgaacgccaacatcggcaactctgcggtcagctcgagcatcgaggaggaggtggagaagctgcagtggagcaccatctggggtgccgacacggccatggacctgagcaccggcaacaacatccacgagacgcgcgagtgggtgatgcgcaacagcccggtccctgtgggtacggtccctatctaccagtgcctggagaaggcgggcggcatcgtggagaacatcacctgggagctgttccgggagacgctgatcgagcaggccgagcagggcgtcgactactttaccatccacgcgggggtcctgctccgctacatccccctgacggcgaaccgcgtcaccggcatcgtcagccgcggcggctctatccatgccaagctctgcctgctggaccacaccgagaacttcgcctacatgcactgggacgagatcctggacatctgcgcccagtacgacatcaccctgtcgatcggcgacggcctgcgccccggctgcatcgcggacgccaacgacgctgcccagtttgctgagctgaagacccagggcgagctgacccgccgcgcctgggcgaaggacgtgcaggtgatgaacgagggtcccggccatgtgccgctgcacaagatccccgagaacatggagaagcagctggactggtgcagcgaggcgcccttctacacgctcggccccctggcgacggacatcgcgcctgcgtacgaccacatcacctccgcgatcggcgccgccacgatcggcgcgctggggaccgcgctgctgtgttacgtgaccccgaaggagcacctgggcctccccgatcgcgacgacgtgaaggccggggtgatcgcctacaagatcgcggcgcacgcggctgacctggcgaagggtcacccctacgctcaggagtgggataacgccctctctaaggcgcgcttcgagttccggtggtacgaccagttccacctgtcgctggaccccgtcaccgcccgcctgttccatgacgcgaccctgccgcaggagcccgccaagaccgcccacttctgctccatgtgcggccccaagttctgctccatgcagatcacccaggacctccgcgagtacgccaagaaccatcaaatggaggaggacgaggcgatccaaaccggcatggccgagatgtccgagcagttcaagagcatcggcgcggaggtctacctcgacgaggcggtgctggagcacgcgtaacaattg

SEQ ID NO: 132 - DNA, 1182 bp, Chlorella protothecoides
actagagagtttaggtccagcgtccgtggggggggacgggctgggagcttgggccgggaagggcaagacgatgcagtccctctggggagtcacagccgactgtgtgtgttgcactgtgcggcccgcagcactcacacgcaaaatgcctggccgacaggcaggccctgtccagtgcaacatccacggtccctctcatcaggctcaccttgctcattgacataacggaatgcgtaccgctctttcagatctgtccatccagagaggggagcaggctccccaccgacgctgtcaaacttgcttcctgcccaaccgaaaacattattgtttgagggggggggggggggggcagattgcatggcgggatatctcgtgaggaacatcactgggacactgtggaacacagtgagtgcagtatgcagagcatgtatgctaggggtcagcgcaggaagggggcctttcccagtctcccatgccactgcaccgtatccacgactcaccaggaccagcttcttgatcggcttccgctcccgtggacaccagtgtgtagcctctggactccaggtatgcgtgcaccgcaaaggccagccgatcgtgccgattcctggggtggaggatatgagtcagccaacttggggctcagagtgcacactggggcacgatacgaaacaacatctacaccgtgtcctccatgctgacacaccacagcttcgctccacctgaatgtgggcgcatgggcccgaatcacagccaatgtcgctgctgccataatgtgatccagaccctctccgcccagatgccgagcggatcgtgggcgctgaatagattcctgtttcgatcactgtttgggtcctttccttttcgtctcggatgcgcgtctcgaaacaggctgcgtcgggctttcggatcccttttgctccctccgtcaccatcctgcgcgcgggcaagttgcttgaccctgggctggtaccagggttggagggtattaccgcgtcaggccattcccagcccggattcaattcaaagtctgggccaccaccctccgccgctctgtctgatcactccacattcgtgcatacactacgttcaagtcctgatccaggcgtgtctcgggacaaggtgtgcttgagtttgaatctcaaggacccactccagcacagctgctggttgaccccgccctcgcaa

SEQ ID NO: 133 - DNA, 161 bp, Chlorella protothecoides
acggagcgtcgtgcgggagggagtgtgccgagcggggagtcccggtctgtgcgaggcccggcagctgacgctggcgagccgtacgccccgagggtccccctcccctgcaccctcttccccttccctctgacggccgcgcctgttcttgcatgttcagcgac

SEQ ID NO: 134 - DNA, 6306 bp, Arabidopsis thaliana
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatccactagagagtttaggtccagcgtccgtggggggggacgggctgggagcttgggccgggaagggcaagacgatgcagtccctctggggagtcacagccgactgtgtgtgttgcactgtgcggcccgcagcactcacacgcaaaatgcctggccgacaggcaggccctgtccagtgcaacatccacggtccctctcatcaggctcaccttgctcattgacataacggaatgcgtaccgctctttcagatctgtccatccagagaggggagcaggctccccaccgacgctgtcaaacttgcttcctgcccaaccgaaaacattattgtttgagggggggggggggggggcagattgcatggcgggatatctcgtgaggaacatcactgggacactgtggaacacagtgagtgcagtatgcagagcatgtatgctaggggtcagcgcaggaagggggcctttcccagtctcccatgccactgcaccgtatccacgactcaccaggaccagcttcttgatcggcttccgctcccgtggacaccagtgtgtagcctctggactccaggtatgcgtgcaccgcaaaggccagccgatcgtgccgattcctggggtggaggatatgagtcagccaacttggggctcagagtgcacactggggcacgatacgaaacaacatctacaccgtgtcctccatgctgacacaccacagcttcgctccacctgaatgtgggcgcatgggcccgaatcacagccaatgtcgctgctgccataatgtgatccagaccctctccgcccagatgccgagcggatcgtgggcgctgaatagattcctgtttcgatcactgtttgggtcctttccttttcgtctcggatgcgcgtctcgaaacaggctgcgtcgggctttcggatcccttttgctccctccgtcaccatcctgcgcgcgggcaagttgcttgaccctgggctggtaccagggttggagggtattaccgcgtcaggccattcccagcccggattcaattcaaagtctgggccaccaccctccgccgctctgtctgatcactccacattcgtgcatacactacgttcaagtcctgatccaggcgtgtctcgggacaaggtgtgcttgagtttgaatctcaaggacccactccagcacagctgctggttgaccccgccctcgcaaactagtatggccaccgcatccactttctcggcgttcaatgcccgctgcggcgacctgcgtcgctcggcgggctccgggccccggcgcccagcgaggcccctccccgtgcgcgggcgcgccgtccaggccgcggccacccgcttcaagaaggagacgacgaccacccgcgccacgctgacgttcgacccccccacgaccaactccgagcgcgccaagcagcgcaagcacaccatcgacccctcctcccccgacttccagcccatcccctccttcgaggagtgcttccccaagtccacgaaggagcacaaggaggtggtgcacgaggagtccggccacgtcctgaaggtgcccttccgccgcgtgcacctgtccggcggcgagcccgccttcgacaactacgacacgtccggcccccagaacgtcaacgcccacatcggcctggcgaagctgcgcaaggagtggatcgaccgccgcgagaagctgggcacgccccgctacacgcagatgtactacgcgaagcagggcatcatcacggaggagatgctgtactgcgcgacgcgcgagaagctggaccccgagttcgtccgctccgaggtcgcgcggggccgcgccatcatcccctccaacaagaagcacctggagctggagcccatgatcgtgggccgcaagttcctggtgaaggtgaacgcgaacatcggcaactccgccgtggcctcctccatcgaggaggaggtctacaaggtgcagtgggccaccatgtggggcgccgacaccatcatggacctgtccacgggccgccacatccacgagacgcgcgagtggatcctgcgcaactccgcggtccccgtgggcaccgtccccatctaccaggcgctggagaaggtggacggcatcgcggagaacctgaactgggaggtgttccgcgagacgctgatcgagcaggccgagcagggcgtggactacttcacgatccacgcgggcgtgctgctgcgctacatccccctgaccgccaagcgcctgacgggcatcgtgtcccgcggcggctccatccacgcgaagtggtgcctggcctaccacaaggagaacttcgcctacgagcactgggacgacatcctggacatctgcaaccagtacgacgtcgccctgtccatcggcgacggcctgcgccccggctccatctacgacgccaacgacacggcccagttcgccgagctgctgacccagggcgagctgacgcgccgcgcgtgggagaaggacgtgcaggtgatgaacgagggccccggccacgtgcccatgcacaagatccccgagaacatgcagaagcagctggagtggtgcaacgaggcgcccttctacaccctgggccccctgacgaccgacatcgcgcccggctacgaccacatcacctccgccatcggcgcggccaacatcggcgccctgggcaccgccctgctgtgctacgtgacgcccaaggagcacctgggcctgcccaaccgcgacgacgtgaaggcgggcgtcatcgcctacaagatcgccgcccacgcggccgacctggccaagcagcacccccacgcccaggcgtgggacgacgcgctgtccaaggcgcgcttcgagttccgctggatggaccagttcgcgctgtccctggaccccatgacggcgatgtccttccacgacgagacgctgcccgcggacggcgcgaaggtcgcccacttctgctccatgtgcggccccaagttctgctccatgaagatcacggaggacatccgcaagtacgccgaggagaacggctacggctccgccgaggaggccatccgccagggcatggacgccatgtccgaggagttcaacatcgccaagaagacgatctccggcgagcagcacggcgaggtcggcggcgagatctacctgcccgagtcctacgtcaaggccgcgcagaagtgatacgtactcgagacggagcgtcgtgcgggagggagtgtgccgagcggggagtcccggtctgtgcgaggcccggcagctgacgctggcgagccgtacgccccgagggtccccctcccctgcaccctcttccccttccctctgacggccgcgcctgttcttgcatgttcagcgacgagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 135 - DNA, 1938 bp, Artificial Sequence
  synthesized construct
atggccaccgcatccactttctcggcgttcaatgcccgctgcggcgacctgcgtcgctcggcgggctccgggccccggcgcccagcgaggcccctccccgtgcgcgggcgcgccgtccaggccgcggccacccgcttcaagaaggagacgacgaccacccgcgccacgctgacgttcgacccccccacgaccaactccgagcgcgccaagcagcgcaagcacaccatcgacccctcctcccccgacttccagcccatcccctccttcgaggagtgcttccccaagtccacgaaggagcacaaggaggtggtgcacgaggagtccggccacgtcctgaaggtgcccttccgccgcgtgcacctgtccggcggcgagcccgccttcgacaactacgacacgtccggcccccagaacgtcaacgcccacatcggcctggcgaagctgcgcaaggagtggatcgaccgccgcgagaagctgggcacgccccgctacacgcagatgtactacgcgaagcagggcatcatcacggaggagatgctgtactgcgcgacgcgcgagaagctggaccccgagttcgtccgctccgaggtcgcgcggggccgcgccatcatcccctccaacaagaagcacctggagctggagcccatgatcgtgggccgcaagttcctggtgaaggtgaacgcgaacatcggcaactccgccgtggcctcctccatcgaggaggaggtctacaaggtgcagtgggccaccatgtggggcgccgacaccatcatggacctgtccacgggccgccacatccacgagacgcgcgagtggatcctgcgcaactccgcggtccccgtgggcaccgtccccatctaccaggcgctggagaaggtggacggcatcgcggagaacctgaactgggaggtgttccgcgagacgctgatcgagcaggccgagcagggcgtggactacttcacgatccacgcgggcgtgctgctgcgctacatccccctgaccgccaagcgcctgacgggcatcgtgtcccgcggcggctccatccacgcgaagtggtgcctggcctaccacaaggagaacttcgcctacgagcactgggacgacatcctggacatctgcaaccagtacgacgtcgccctgtccatcggcgacggcctgcgccccggctccatctacgacgccaacgacacggcccagttcgccgagctgctgacccagggcgagctgacgcgccgcgcgtgggagaaggacgtgcaggtgatgaacgagggccccggccacgtgcccatgcacaagatccccgagaacatgcagaagcagctggagtggtgcaacgaggcgcccttctacaccctgggccccctgacgaccgacatcgcgcccggctacgaccacatcacctccgccatcggcgcggccaacatcggcgccctgggcaccgccctgctgtgctacgtgacgcccaaggagcacctgggcctgcccaaccgcgacgacgtgaaggcgggcgtcatcgcctacaagatcgccgcccacgcggccgacctggccaagcagcacccccacgcccaggcgtgggacgacgcgctgtccaaggcgcgcttcgagttccgctggatggaccagttcgcgctgtccctggaccccatgacggcgatgtccttccacgacgagacgctgcccgcggacggcgcgaaggtcgcccacttctgctccatgtgcggccccaagttctgctccatgaagatcacggaggacatccgcaagtacgccgaggagaacggctacggctccgccgaggaggccatccgccagggcatggacgccatgtccgaggagttcaacatcgccaagaagacgatctccggcgagcagcacggcgaggtcggcggcgagatctacctgcccgagtcctacgtcaaggccgcgcagaagtga

SEQ ID NO: 136 - protein, 644 aa, Arabidopsis thaliana
MAASVHCTLMSVVCNNKNHSARPKLPNSSLLPGFDVVVQAAATRFKKETTTTRATLTFDPPTTNSERAKQRKHTIDPSSPDFQPIPSFEECFPKSTKEHKEVVHEESGHVLKVPFRRVHLSGGEPAFDNYDTSGPQNVNAHIGLAKLRKEWIDRREKLGTPRYTQMYYAKQGIITEEMLYCATREKLDPEFVRSEVARGRAIIPSNKKHLELEPMIVGRKFLVKVNANIGNSAVASSIEEEVYKVQWATMWGADTIMDLSTGRHIHETREWILRNSAVPVGTVPIYQALEKVDGIAENLNWEVFRETLIEQAEQGVDYFTIHAGVLLRYIPLTAKRLTGIVSRGGSIHAKWCLAYHKENFAYEHWDDILDICNQYDVALSIGDGLRPGSIYDANDTAQFAELLTQGELTRRAWEKDVQVMNEGPGHVPMHKIPENMQKQLEWCNEAPFYTLGPLTTDIAPGYDHITSAIGAANIGALGTALLCYVTPKEHLGLPNRDDVKAGVIAYKIAAHAADLAKQHPHAQAWDDALSKARFEFRWMDQFALSLDPMTAMSFHDETLPADGAKVAHFCSMCGPKFCSMKITEDIRKYAEENGYGSAEEAIRQGMDAMSEEFNIAKKTISGEQHGEVGGEIYLPESYVKAAQK

SEQ ID NO: 137 - DNA, 6130 bp, Unknown
  Synechocystis species
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatccactagagagtttaggtccagcgtccgtggggggggacgggctgggagcttgggccgggaagggcaagacgatgcagtccctctggggagtcacagccgactgtgtgtgttgcactgtgcggcccgcagcactcacacgcaaaatgcctggccgacaggcaggccctgtccagtgcaacatccacggtccctctcatcaggctcaccttgctcattgacataacggaatgcgtaccgctctttcagatctgtccatccagagaggggagcaggctccccaccgacgctgtcaaacttgcttcctgcccaaccgaaaacattattgtttgagggggggggggggggggcagattgcatggcgggatatctcgtgaggaacatcactgggacactgtggaacacagtgagtgcagtatgcagagcatgtatgctaggggtcagcgcaggaagggggcctttcccagtctcccatgccactgcaccgtatccacgactcaccaggaccagcttcttgatcggcttccgctcccgtggacaccagtgtgtagcctctggactccaggtatgcgtgcaccgcaaaggccagccgatcgtgccgattcctggggtggaggatatgagtcagccaacttggggctcagagtgcacactggggcacgatacgaaacaacatctacaccgtgtcctccatgctgacacaccacagcttcgctccacctgaatgtgggcgcatgggcccgaatcacagccaatgtcgctgctgccataatgtgatccagaccctctccgcccagatgccgagcggatcgtgggcgctgaatagattcctgtttcgatcactgtttgggtcctttccttttcgtctcggatgcgcgtctcgaaacaggctgcgtcgggctttcggatcccttttgctccctccgtcaccatcctgcgcgcgggcaagttgcttgaccctgggctggtaccagggttggagggtattaccgcgtcaggccattcccagcccggattcaattcaaagtctgggccaccaccctccgccgctctgtctgatcactccacattcgtgcatacactacgttcaagtcctgatccaggcgtgtctcgggacaaggtgtgcttgagtttgaatctcaaggacccactccagcacagctgctggttgaccccgccctcgcaaactagtatggccaccgcatccactttctcggcgttcaatgcccgctgcggcgacctgcgtcgctcggcgggctccgggccccggcgcccagcgaggcccctccccgtgcgcgggcgcgccatgcgcaccgcgtgggtcgccaagcgccagggccagacgaacgtctcccagatgcactacgcgcgcaagggcgtgatcaccgaggagatggactacgtggcgaagcgcgagaacctgcccgtggagctgatcaaggacgaggtggcgcggggccgcatgatcatccccgccaacatcaaccacacgaacctggagcccatggccatcggcatcgcctccaagtgcaaggtcaacgcgaacatcggcgcgtcccccaactcctccaacatcgacgaggaggtggagaagctgctgctgtccgtgaagtacggcgcggacacggtgatggacctgtccaccggcggcggcgacctggacgtgatccgcaccgccatcatcaacgcctcccccgtgcccatcggcacggtgcccatctaccaggccctggagtccgtgcacggctccatcgagaacctgacgcccgacgacttcctgcacatcatcgagaagcacgcccagcagggcgtggactacatgacgatccacgcgggcctgctgatcgagtacctgcccctggtgaagtcccgcatcacgggcatcgtgtcccgcggcggcggcatcatcgccaagtggatgctgcaccaccacaagcagaaccccctgtacacgcacttcgacgagatcatcgagatcttcaagaagtacgacgtgtccttctccctgggcgactccctgcgccccggctgcacccacgacgcctccgacgacgcccagctgtccgagctgaagacgctgggccagctgacgcgccgcgcctgggagcacgacgtccaggtcatggtggagggccccggccacgtccccatcgaccagatcgagttcaacgtcaagaagcagatggaggagtgctccgaggcccccttctacgtgctgggccccctggtcaccgacatcgcgcccggctacgaccacatcacctccgcgatcggcgccgccatcgcgggctggcacggcaccgcgatgctgtgctacgtgacgcccaaggagcacctgggcctgcccaacgcggaggacgtgcgcaacggcctgatcgcctacaagatcgccgcgcacgccgcggacatcgcccgccaccgccccggcgcgcgcgaccgcgacgacgagctgtccaaggcgcgctacaacttcgactggaaccgccagttcgagctgtccctggaccccgagcgcgcgaaggagtaccacgacgagacgctgcccgcggacatctacaagaccgcggagttctgctccatgtgcggccccaagttctgccccatgcagaccaaggtggacgccgagatgctggaggagctggaggtcttcctggccaaggacaaggagatggtgtcccagcgctgatacgtactcgagacggagcgtcgtgcgggagggagtgtgccgagcggggagtcccggtctgtgcgaggcccggcagctgacgctggcgagccgtacgccccgagggtccccctcccctgcaccctcttccccttccctctgacggccgcgcctgttcttgcatgttcagcgacgagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttc

SEQ ID NO: 138 - DNA, 1494 bp, Artificial Sequence
  synthesized construct
atggccaccgcatccactttctcggcgttcaatgcccgctgcggcgacctgcgtcgctcggcgggctccgggccccggcgcccagcgaggcccctccccgtgcgcgggcgcgccatgcgcaccgcgtgggtcgccaagcgccagggccagacgaacgtctcccagatgcactacgcgcgcaagggcgtgatcaccgaggagatggactacgtggcgaagcgcgagaacctgcccgtggagctgatcaaggacgaggtggcgcggggccgcatgatcatccccgccaacatcaaccacacgaacctggagcccatggccatcggcatcgcctccaagtgcaaggtcaacgcgaacatcggcgcgtcccccaactcctccaacatcgacgaggaggtggagaagctgctgctgtccgtgaagtacggcgcggacacggtgatggacctgtccaccggcggcggcgacctggacgtgatccgcaccgccatcatcaacgcctcccccgtgcccatcggcacggtgcccatctaccaggccctggagtccgtgcacggctccatcgagaacctgacgcccgacgacttcctgcacatcatcgagaagcacgcccagcagggcgtggactacatgacgatccacgcgggcctgctgatcgagtacctgcccctggtgaagtcccgcatcacgggcatcgtgtcccgcggcggcggcatcatcgccaagtggatgctgcaccaccacaagcagaaccccctgtacacgcacttcgacgagatcatcgagatcttcaagaagtacgacgtgtccttctccctgggcgactccctgcgccccggctgcacccacgacgcctccgacgacgcccagctgtccgagctgaagacgctgggccagctgacgcgccgcgcctgggagcacgacgtccaggtcatggtggagggccccggccacgtccccatcgaccagatcgagttcaacgtcaagaagcagatggaggagtgctccgaggcccccttctacgtgctgggccccctggtcaccgacatcgcgcccggctacgaccacatcacctccgcgatcggcgccgccatcgcgggctggcacggcaccgcgatgctgtgctacgtgacgcccaaggagcacctgggcctgcccaacgcggaggacgtgcgcaacggcctgatcgcctacaagatcgccgcgcacgccgcggacatcgcccgccaccgccccggcgcgcgcgaccgcgacgacgagctgtccaaggcgcgctacaacttcgactggaaccgccagttcgagctgtccctggaccccgagcgcgcgaaggagtaccacgacgagacgctgcccgcggacatctacaagaccgcggagttctgctccatgtgcggccccaagttctgccccatgcagaccaaggtggacgccgagatgctggaggagctggaggtcttcctggccaaggacaaggagatggtgtcccagcgctga

SEQ ID NO: 139 - protein, 459 aa, Unknown
  Synechosystis species
MRTAWVAKRQGQTNVSQMHYARKGVITEEMDYVAKRENLPVELIKDEVARGRMIIPANINHTNLEPMAIGIASKCKVNANIGASPNSSNIDEEVEKLLLSVKYGADTVMDLSTGGGDLDVIRTAIINASPVPIGTVPIYQALESVHGSIENLTPDDFLHIIEKHAQQGVDYMTIHAGLLIEYLPLVKSRITGIVSRGGGIIAKWMLHHHKQNPLYTHFDEIIEIFKKYDVSFSLGDSLRPGCTHDASDDAQLSELKTLGQLTRRAWEHDVQVMVEGPGHVPIDQIEFNVKKQMEECSEAPFYVLGPLVTDIAPGYDHITSAIGAAIAGWHGTAMLCYVTPKEHLGLPNAEDVRNGLIAYKIAAHAADIARHRPGARDRDDELSKARYNFDWNRQFELSLDPERAKEYHDETLPADIYKTAEFCSMCGPKFCPMQTKVDAEMLEELEVFLAKDKEMVSQR

SEQ ID NO: 140 - DNA, 312 bp, Artificial Sequence; identical to SEQ ID NO: 114
  synthesized construct

SEQ ID NO: 141 - DNA, 18 bp, Unknown
  Coccomyxa species
gggtgatcgcctacaaga

SEQ ID NO: 142 - DNA, 20 bp, Artificial Sequence
  synthesized primer
acgtcgcgacccatgcttcc

SEQ ID NO: 143 - DNA, 18 bp, Arabidopsis thaliana
gcgtcatcgcctacaaga

SEQ ID NO: 144 - DNA, 18 bp, Unknown
  Synechosystis sp.
cgatgctgtgctacgtga

SEQ ID NO: 145 - DNA, 1260 bp, Artificial Sequence; identical to SEQ ID NO: 43
  synthesized construct

SEQ ID NO: 146 - protein, 429 aa, Myristica fragrans
MVATSAASAFFPVASPSPVKPSMMLGGGGGSDNLDARGIKSRPASSGGLQVKANAHTVPKINGNKAGLLTPMESTKDEDIVAAPTVAPKRTFINQLPDWSMLLAAITTIFLAAEKQWTNLDWKPRRPDMLVDFDPFSLGRFVQDGLIFRQNFSIRSYEIGADRTASIETLMNHLQETALNHVRCIGLLDDGFGSTPEMTRRDLIWVVTRMQVLVDRYPSWGDVIEVDSWVTPSGKNGMKREWFLRDCKTGEILTRATSVWVMMNKRTRRLSKIPEEVRVEIEPYFVEHGVLDEDSRKLPKLNDNTANYIRRGLAPRWSDLDVNQHVNNVKYIGWILESVPSSLLESHELYGMTLEYRKECGKDGLLQSLTAVASDYGGGSLEAGVECDHLLRLEDGSEIMRGKTEWRPKRAANTTYFGSVDDIPPANNA

SEQ ID NO: 147 - DNA, 1269 bp, Artificial Sequence
  synthesized construct
actagtatggccaccgcatccactttctcggcgttcaatgcccgctgcggcgacctgcgtcgctcggcgggctccgggccccggcgcccagcgaggcccctccccgtgcgcgggcgcgccgccaacgcccaggcccccaccaagatcaacggctccaccgacgacgcccagctgcccgccccccgcaccttcatcaaccagctgcccgactggtccatgctgctggccgccatcaccaccgtgttcctggccgccgagaagcagtggatgatgctggactggaagccccgccgccccgacatgctgatcgacaccttcggcctgggccgcatcgtgcaggacggcctggtgttccgccagaacttctccatccgctcctacgagatcggcgccgaccgcaccgcctccatcgagaccgtgatgaaccacctgcaggagaccgccctgaaccacgtgaagaccgccggcctgctgggcgacggcttcggctccacccccgagatgtccaagcgcaacctgatctgggtggtgaccaagatgcaggtggaggtggaccgctaccccacctggggcgacgtggtgcaggtggacacctgggtgtccgcctccggcaagaacggcatgcgccgcgactggctgctgcgcgacggcaacaccggcgagaccctgacccgcgcctcctccgtgtgggtgatgatgaacaagctgacccgccgcctgtccaagatccccgaggaggtgcgcgaggagatcggctcctacttcgtgaactccgaccccgtggtggaggaggacggccgcaaggtgaccaagctggacgacaacaccgccgacttcgtgcgcaagggcctgacccccaagtggaacgacctggacatcaaccagcacgtgaacaacgtgaagtacatcggctggatcctggagtccgccccccagcccatcctggagacccgcgagctgtccgccgtgaccctggagtaccgccgcgagtgcggccgcgactccgtgctgcgctccctgaccgccgtgtccggcggcggcgtgggcgacctgggccacgccggcaacgtggagtgccagcacgtgctgcgcctggaggacggcgccgagatcgtgcgcggccgcaccgagtggcgccccaagtacatcaacaacttctccatcatgggccagatccccaccgacgcctccatggactacaaggaccacgacggcgactacaaggaccacgacatcgactacaaggacgacgacgacaagtgaatcgat

SEQ ID NO: 148 - protein, 406 aa, Garcinia mangostana
MVATAATSSFFPLTSPSGDAKSGNPGKGSVSFGSMKSKSAASSRGLQVKANAQAPTKINGSTDDAQLPAPRTFINQLPDWSMLLAAITTVFLAAEKQWMMLDWKPRRPDMLIDTFGLGRIVQDGLVFRQNFSIRSYEIGADRTASIETVMNHLQETALNHVKTAGLLGDGFGSTPEMSKRNLIWVVTKMQVEVDRYPTWGDVVQVDTWVSASGKNGMRRDWLLRDGNTGETLTRASSVWVMMNKLTRRLSKIPEEVREEIGSYFVNSDPVVEEDGRKVTKLDDNTADFVRKGLTPKWNDLDINQHVNNVKYIGWILESAPQPILETRELSAVTLEYRRECGRDSVLRSLTAVSGGGVGDLGHAGNVECQHVLRLEDGAEIVRGRTEWRPKYINNFSIMGQIPTDAS

SEQ ID NO: 149 - DNA, 1338 bp, Artificial Sequence
  synthesized construct
actagtatggtggccaccgccgcctcctccgccttcttccccctgccctccgccgacacctcctcccgccccggcaagctgggcaacaagccctcctccctgtcccccctgaagcccaagtccacccccaacggcggcctgcaggtgaaggccaacgcctccgccccccccaagatcaacggctcccccgtgggcctgaagtccggcggcctgaaggggcgcgccacccaggaggacgcccactccgccccccccccccgcaccttcatcaaccagctgcccgactggtccatgctgctggccgccatcaccaccgtgttcctggccgccgagaagcagtggatgatgctggactggaagcccaagcgccccgacatgctggtggaccccttcggcctgggctccatcgtgcaggacggcctggtgttccgccagaacttctccatccgctcctacgagatcggcgccgaccgcaccgcctccatcgagaccgtgatgaaccacctgcaggagaccgccctgaaccacgtgaagatcgccggcctgtccaacgacggcttcggccgcacccccgagatgtacaagcgcgacctgatctgggtggtggccaagatgcaggtgatggtgaaccgctaccccacctggggcgacaccgtggaggtgaacacctgggtggccaagtccggcaagaacggcatgcgccgcgactggctgatctccgactgcaacaccggcgagatcctgacccgcgcctcctccgtgtgggtgatgatgaaccagaagacccgccgcctgtccaagatccccgacgaggtgcgcaacgagatcgagccccacttcgtggactccccccccgtgatcgaggacgacgaccgcaagctgcccaagctggacgagaagaccgccgactccatccgcaagggcctgaccccccgctggaacgacctggacgtgaaccagcacgtgaacaacgtgaagtacatcggctggatcctggagtccaccccccccgaggtgctggagacccaggagctgtgctccctgaccctggagtaccgccgcgagtgcggccgcgagtccgtgctggagtccctgaccgccatggacccctccggcggcggctacggctcccagttccagcacctgctgcgcctggaggacggcggcgagatcgtgaagggccgcaccgagtggcgccccaagaacggcgtgatcaacggcgtggtgcccaccggcgagtcctcccccggcgactactccatggactacaaggaccacgacggcgactacaaggaccacgacatcgactacaaggacgacgacgacaagtgaatcgat

SEQ ID NO: 150 - protein, 415 aa, Cuphea hookeriana
MVATAASSAFFPLPSADTSSRPGKLGNKPSSLSPLKPKSTPNGGLQVKANASAPPKINGSPVGLKSGGLKTQEDAHSAPPPRTFINQLPDWSMLLAAITTVFLAAEKQWMMLDWKPKRPDMLVDPFGLGSIVQDGLVFRQNFSIRSYEIGADRTASIETVMNHLQETALNHVKIAGLSNDGFGRTPEMYKRDLIWVVAKMQVMVNRYPTWGDTVEVNTWVAKSGKNGMRRDWLISDCNTGEILTRASSVWVMMNQKTRRLSKIPDEVRNEIEPHFVDSPPVIEDDDRKLPKLDEKTADSIRKGLTPRWNDLDVNQHVNNVKYIGWILESTPPEVLETQELCSLTLEYRRECGRESVLESLTAMDPSGGGYGSQFQHLLRLEDGGEIVKGRTEWRPKNGVINGVVPTGESSPGDYS

SEQ ID NO: 151 - DNA, 1344 bp, Artificial Sequence
  synthesized construct
actagtatggtggcctccatcgtggcctgggccttcttccccaccccctccttctcccccaccgggcgcgccgcctccgccaaggcctccaagaccatcggcgagggctccgagaacctgaacgtgcgcggcatcatcgccaagcccacctcctcctccgccgccaagcagggcaaggtgatggcccaggccgtgcccaagatcaacggcgccaaggtgggcctgaaggccgagtcccagaaggccgaggaggacgccgccccctcctccgccccccgcaccttctacaaccagctgcccgactggtccgtgctgctggccgccgtgaccaccatcttcctggccgccgagaagcagtggaccctgctggactggaagccccgccgccccgacatgctgaccggcgccttctccctgggcaagatcgtgcaggacggcctggtgttccgccagaacttctccatccgctcctacgagatcggcgccgaccgcaccgcctccatcgagaccctgatgaaccacctgcaggagaccgccctgaaccacgtgcgcaacgccggcctgctgggcgacggcttcggcgccacccccgagatgtccaagcgcaacctgatctgggtggtgaccaagatgcaggtgctgatcgagcactacccctcctggggcgacgtggtggaggtggacacctgggtgggcgcctccggcaagaacggcatgcgccgcgactggcacgtgcgcgactaccgcaccggccagaccatcctgcgcgccacctccatctgggtgatgatggacaagcacacccgcaagctgtccaagatgcccgaggaggtgcgcgccgagatcggcccctacttcatggagcacgccgccatcgtggacgaggactcccgcaagctgcccaagctggacgacgacaccgccgactacatcaagtggggcctgaccccccgctggtccgacctggacgtgaaccagcacgtgaacaacgtgaagtacatcggctggatcctggagtccgcccccatctccatcctggagaaccacgagctggcctccatgaccctggagtaccgccgcgagtgcggccgcgactccgtgctgcagtccctgaccgccgtggccaacgactgcaccggcggcctgcccgaggcctccatcgagtgccagcacctgctgcagctggagtgcggcgccgagatcgtgcgcggccgcacccagtggcgcccccgccgcgcctccggccccacctccgccggctccgccatggactacaaggaccacgacggcgactacaaggaccacgacatcgactacaaggacgacgacgacaagtgaatcgat

SEQ ID NO: 152 - protein, 417 aa, Elaeis guiniensis
MVASIVAWAFFPTPSFSPTASAKASKTIGEGSENLNVRGIIAKPTSSSAAKQGKVMAQAVPKINGAKVGLKAESQKAEEDAAPSSAPRTFYNQLPDWSVLLAAVTTIFLAAEKQWTLLDWKPRRPDMLTGAFSLGKIVQDGLVFRQNFSIRSYEIGADRTASIETLMNHLQETALNHVRNAGLLGDGFGATPEMSKRNLIWVVTKMQVLIEHYPSWGDVVEVDTWVGASGKNGMRRDWHVRDYRTGQTILRATSIWVMMDKHTRKLSKMPEEVRAEIGPYFMEHAAIVDEDSRKLPKLDDDTADYIKWGLTPRWSDLDVNQHVNNVKYIGWILESAPISILENHELASMTLEYRRECGRDSVLQSLTAVANDCTGGLPEASIECQHLLQLECGAEIVRGRTQWRPRRASGPTSAGSA

SEQ ID NO: 153 - DNA, 1191 bp, Artificial Sequence
  synthesized construct
actagtatgctgaagctgtcctgcaacgtgaccaacaacctgcacaccttctccttcttctccgactcctccctgttcatccccgtgaaccgccgcaccatcgccgtgtcctccgggcgcgcctcccagctgcgcaagcccgccctggaccccctgcgcgccgtgatctccgccgaccagggctccatctcccccgtgaactcctgcacccccgccgaccgcctgcgcgccggccgcctgatggaggacggctactcctacaaggagaagttcatcgtgcgctcctacgaggtgggcatcaacaagaccgccaccgtggagaccatcgccaacctgctgcaggaggtggcctgcaaccacgtgcagaagtgcggcttctccaccgacggcttcgccaccaccctgaccatgcgcaagctgcacctgatctgggtgaccgcccgcatgcacatcgagatctacaagtaccccgcctggtccgacgtggtggagatcgagacctggtgccagtccgagggccgcatcggcacccgccgcgactggatcctgcgcgactccgccaccaacgaggtgatcggccgcgccacctccaagtgggtgatgatgaaccaggacacccgccgcctgcagcgcgtgaccgacgaggtgcgcgacgagtacctggtgttctgcccccgcgagccccgcctggccttccccgaggagaacaactcctccctgaagaagatccccaagctggaggaccccgcccagtactccatgctggagctgaagccccgccgcgccgacctggacatgaaccagcacgtgaacaacgtgacctacatcggctgggtgctggagtccatcccccaggagatcatcgacacccacgagctgcaggtgatcaccctggactaccgccgcgagtgccagcaggacgacatcgtggactccctgaccacctccgagatccccgacgaccccatctccaagttcaccggcaccaacggctccgccatgtcctccatccagggccacaacgagtcccagttcctgcacatgctgcgcctgtccgagaacggccaggagatcaaccgcggccgcacccagtggcgcaagaagtcctcccgcatggactacaaggaccacgacggcgactacaaggaccacgacatcgactacaaggacgacgacgacaagtgaatcgat

SEQ ID NO: 154 - protein, 366 aa, Brassica napus
MLKLSCNVTNNLHTFSFFSDSSLFIPVNRRTIAVSSSQLRKPALDPLRAVISADQGSISPVNSCTPADRLRAGRLMEDGYSYKEKFIVRSYEVGINKTATVETIANLLQEVACNHVQKCGFSTDGFATTLTMRKLHLIWVTARMHIEIYKYPAWSDVVEIETWCQSEGRIGTRRDWILRDSATNEVIGRATSKWVMMNQDTRRLQRVTDEVRDEYLVFCPREPRLAFPEENNSSLKKIPKLEDPAQYSMLELKPRRADLDMNQHVNNVTYIGWVLESIPQEIIDTHELQVITLDYRRECQQDDIVDSLTTSEIPDDPISKFTGTNGSAMSSIQGHNESQFLHMLRLSENGQEINRGRTQWRKKSSR

SEQ ID NO: 155 - DNA, 1038 bp, Artificial Sequence
  synthesized construct
actagtatggccaccgcatccactttctcggcgttcaatgcccgctgcggcgacctgcgtcgctcggcgggctccgggccccggcgcccagcgaggcccctccccgtgcgcgggcgcgcccgctcctacgaggtgggcatcaacaagaccgccaccgtggagaccatcgccaacctgctgcaggaggtgggctgcaaccacgcccagtccgtgggcttctccaccgacggcttcgccaccaccacctccatgcgcaagatgcacctgatctgggtgaccgcccgcatgcacatcgagatctacaagtaccccgcctggtccgacgtggtggaggtggagacctggtgccagtccgagggccgcatcggcacccgccgcgactggatcctgaccgactacgccaccggccagatcatcggccgcgccacctccaagtgggtgatgatgaaccaggacacccgccgcctgcagaaggtgaccgacgacgtgcgcgaggagtacctggtgttctgcccccgcgagctgcgcctggccttccccgaggagaacaaccgctcctccaagaagatctccaagctggaggaccccgcccagtactccaagctgggcctggtgccccgccgcgccgacctggacatgaaccagcacgtgaacaacgtgacctacatcggctgggtgctggagtccatcccccaggagatcatcgacacccacgagctgcagaccatcaccctggactaccgccgcgagtgccagcacgacgacatcgtggactccctgacctccgtggagccctccgagaacctggaggccgtgtccgagctgcgcggcaccaacggctccgccaccaccaccgccggcgacgaggactgccgcaacttcctgcacctgctgcgcctgtccggcgacggcctggagatcaaccgcggccgcaccgagtggcgcaagaagtccgcccgcatggactacaaggaccacgacggcgactacaaggaccacgacatcgactacaaggacgacgacgacaagtgaatcgat

SEQ ID NO: 156 - protein, 371 aa, Ricinus communis
MLKVPCCNATDPIQSLSSQCRFLTHFNNRPYFTRRPSIPTFFSSKNSSASLQAVVSDISSVESAACDSLANRLRLGKLTEDGFSYKEKFIVRSYEVGINKTATVETIANLLQEVGCNHAQSVGFSTDGFATTTSMRKMHLIWVTARMHIEIYKYPAWSDVVEVETWCQSEGRIGTRRDWILTDYATGQIIGRATSKWVMMNQDTRRLQKVTDDVREEYLVFCPRELRLAFPEENNRSSKKISKLEDPAQYSKLGLVPRRADLDMNQHVNNVTYIGWVLESIPQEIIDTHELQTITLDYRRECQHDDIVDSLTSVEPSENLEAVSELRGTNGSATTTAGDEDCRNFLHLLRLSGDGLEINRGRTEWRKKSAR

SEQ ID NO: 157 - DNA, 1248 bp, Artificial Sequence
  synthesized construct
atggccaccgcatccactttctcggcgttcaatgcccgctgcggcgacctgcgtcgctcggcgggctccgggccccggcgcccagcgaggcccctccccgtgcgcgggcgcgccgccaacgcccacaccgtgcccaagatcaacggcaacaaggccggcctgctgacccccatggagagcaccaaggacgaggacatcgtcgcggcccccaccgtggcgcccaagcgcaccttcatcaaccagctgcccgactggtcgatgctgctggccgcgatcaccaccatcttcctggcggccgagaagcagtggaccaacctggactggaagccccgccgccccgacatgctggtcgacttcgaccccttctccctgggccgcttcgtgcaggacggcctgatcttccgccagaacttcagcatccgctcgtacgagatcggcgcggaccgcaccgcctccatcgagaccctgatgaaccacctgcaggagaccgcgctgaaccacgtccgctgcatcggcctgctggacgacggcttcggcagcacccccgagatgacccgccgcgacctgatctgggtggtcacccgcatgcaggtcctggtggaccgctacccctcgtggggcgacgtgatcgaggtcgactcctgggtgacccccagcggcaagaacggcatgaagcgcgagtggttcctgcgcgactgcaagaccggcgagatcctgacccgcgccacctcggtctgggtgatgatgaacaagcgcacccgccgcctgtccaagatccccgaggaggtccgcgtggagatcgagccctacttcgtcgagcacggcgtgctggacgaggactcgcgcaagctgcccaagctgaacgacaacaccgccaactacatccgccgcggcctggcgccccgctggtccgacctggacgtcaaccagcacgtgaacaacgtcaagtacatcggctggatcctggagagcgtgcccagcagcctgctggagtcgcacgagctgtacggcatgaccctggagtaccgcaaggagtgcggcaaggacggcctgctgcagtccctgaccgccgtcgccagcgactacggcggcggctcgctggaggccggcgtggagtgcgaccacctgctgcgcctggaggacggctccgagatcatgcgcggcaagaccgagtggcgccccaagcgcgccgcgaacaccacctacttcggcagcgtcgacgacatcccccccgccaacaacgcgtga

SEQ ID NO: 158 - protein, 415 aa, Artificial Sequence
  synthesized construct
MATASTFSAFNARCGDLRRSAGSGPRRPARPLPVRGRAANAHTVPKINGNKAGLLTPMESTKDEDIVAAPTVAPKRTFINQLPDWSMLLAAITTIFLAAEKQWTNLDWKPRRPDMLVDFDPFSLGRFVQDGLIFRQNFSIRSYEIGADRTASIETLMNHLQETALNHVRCIGLLDDGFGSTPEMTRRDLIWVVTRMQVLVDRYPSWGDVIEVDSWVTPSGKNGMKREWFLRDCKTGEILTRATSVWVMMNKRTRRLSKIPEEVRVEIEPYFVEHGVLDEDSRKLPKLNDNTANYIRRGLAPRWSDLDVNQHVNNVKYIGWILESVPSSLLESHELYGMTLEYRKECGKDGLLQSLTAVASDYGGGSLEAGVECDHLLRLEDGSEIMRGKTEWRPKRAANTTYFGSVDDIPPANNA

SEQ ID NO: 159 - DNA, 2333 bp, Artificial Sequence
  synthesized construct
ctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcc

SEQ ID NO: 160 - DNA, 1233 bp, Artificial Sequence
  synthesized construct
actagtatggccaccgcatccactttctcggcgttcaatgcccgctgcggcgacctgcgtcgctcggcgggctccgggccccggcgcccagcgaggcccctccccgtgcgcgggcgcgccacccaggaggacgcccactccgccccccccccccgcaccttcatcaaccagctgcccgactggtccatgctgctggccgccatcaccaccgtgttcctggccgccgagaagcagtggatgatgctggactggaagcccaagcgccccgacatgctggtggaccccttcggcctgggctccatcgtgcaggacggcctggtgttccgccagaacttctccatccgctcctacgagatcggcgccgaccgcaccgcctccatcgagaccgtgatgaaccacctgcaggagaccgccctgaaccacgtgaagatcgccggcctgtccaacgacggcttcggccgcacccccgagatgtacaagcgcgacctgatctgggtggtggccaagatgcaggtgatggtgaaccgctaccccacctggggcgacaccgtggaggtgaacacctgggtggccaagtccggcaagaacggcatgcgccgcgactggctgatctccgactgcaacaccggcgagatcctgacccgcgcctcctccgtgtgggtgatgatgaaccagaagacccgccgcctgtccaagatccccgacgaggtgcgcaacgagatcgagccccacttcgtggactccccccccgtgatcgaggacgacgaccgcaagctgcccaagctggacgagaagaccgccgactccatccgcaagggcctgaccccccgctggaacgacctggacgtgaaccagcacgtgaacaacgtgaagtacatcggctggatcctggagtccaccccccccgaggtgctggagacccaggagctgtgctccctgaccctggagtaccgccgcgagtgcggccgcgagtccgtgctggagtccctgaccgccatggacccctccggcggcggctacggctcccagttccagcacctgctgcgcctggaggacggcggcgagatcgtgaagggccgcaccgagtggcgccccaagaacggcgtgatcaacggcgtggtgcccaccggcgagtcctcccccggcgactactccatggactacaaggaccacgacggcgactacaaggaccacgacatcgactacaaggacgacgacgacaagtgaatcgat

SEQ ID NO: 161 - DNA, 1344 bp, Artificial Sequence
  synthesized construct
actagtatggtggcctccatcgccgcctccgccttcttccccaccccctccttctcccccaccgggcgcgccgcctccgccaaggcctccaagaccatcggcgagggctccgagaacctggacgcccgcggcatcatcgccaagcccacctcctcctccgccgccatgcagggcaaggtgatggcccaggccgtgtccaagatcaacggcgccaaggtgggcctgaaggccgagtcccagaaggccgaggaggacgccgccccctcctccgccccccgcaccttctacaaccagctgcccgactggtccgtgctgctggccgccgtgaccaccatcttcctggccgccgagaagcagtggaccctgctggactggaagccccgccgccccgacatgctgaccgacgccttctccctgggcaagatcgtgcaggacggcctggtgttcaagcagaacttctccatccgctcctacgagatcggcgccgaccgcaccgcctccatcgagaccctgatgaaccacctgcaggagaccgccctgaaccacgtgcgctccgccggcctgatgggcgacggcttcggcgccacccccgagatgtccaagcgcaacctgatctgggtggtgaccaaggtgcgcgtgctgatcgagcactacccctcctggggcgacgtggtggaggtggacacctgggtgggccccgccggcaagaacggcatgcgccgcgactggcacgtgcgcgaccaccgcaccggccagaccatcctgcgcgccacccgcgtgtgggtgatgatgaacaagaacacccgcaagctgtccaaggtgcccgaggaggtgcgcgccgagatcggcccctacttcgtggagcgcgccgccatcgtggacgaggactcccgcaagctgcccaagctggacgaggacaccaccgactacgtgaagaagggcctgaccccccgctggtccgacctggacgtgaaccagcacgtgaacaacgtgaagtacatcggctggatcctggagtccgcccccatctccatcctggagaaccacgagctggcctccatgaccctggagtaccgccgcgagtgcggccgcgactccgtgctgcagtccctgaccgccgtggccaacgactgcaccggcggcctgcccgaggcctccatcgagtgccagcacctgctgcagctggagtgcggcgccgagatcgtgcgcggccgcacccagtggcgcccccgccgcgcctccggccccacctccgccggctccgccatggactacaaggaccacgacggcgactacaaggaccacgacatcgactacaaggacgacgacgacaagtgaatcgat

SEQ ID NO: 162 - protein, 417 aa, Elaeis guiniensis
MVASIAASAFFPTPSFSPTASAKASKTIGEGSENLDARGIIAKPTSSSAAMQGKVMAQAVSKINGAKVGLKAESQKAEEDAAPSSAPRTFYNQLPDWSVLLAAVTTIFLAAEKQWTLLDWKPRRPDMLTDAFSLGKIVQDGLVFKQNFSIRSYEIGADRTASIETLMNHLQETALNHVRSAGLMGDGFGATPEMSKRNLIWVVTKVRVLIEHYPSWGDVVEVDTWVGPAGKNGMRRDWHVRDHRTGQTILRATRVWVMMNKNTRKLSKVPEEVRAEIGPYFVERAAIVDEDSRKLPKLDEDTTDYVKKGLTPRWSDLDVNQHVNNVKYIGWILESAPISILENHELASMTLEYRRECGRDSVLQSLTAVANDCTGGLPEASIECQHLLQLECGAEIVRGRTQWRPRRASGPTSAGSA

SEQ ID NO: 163 - DNA, 595 bp, Artificial Sequence
  synthesized construct
actagtatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccaggtgtgtttgagggttttggttgcccgtattgaggtcctggtggcgcgcatggaggagaaggcgcctgtcccgctgacccccccggctaccctcccggcaccttccagggcgcgtacgggaagaaccagtagagcggccacatgatgccgtacttgacccacgtaggcaccggtgcagggtcgatgtacgtcgacgcgacgtagagcagggacatgaccgcgatgtcaaaggccaggtacatgctgctacgaagcgccgagcgctcgaaacagtgcgcggggatggccttgcgcagcgtcccgatcgtgaacggaggcttctccacaggctgcctgttcgtcttgatagccat

SEQ ID NO: 164 - DNA, 6101 bp, Artificial Sequence
  synthesized construct
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccaggtgtgtttgagggttttggttgcccgtattgaggtcctggtggcgcgcatggaggagaaggcgcctgtcccgctgacccccccggctaccctcccggcaccttccagggcgcgtacgggaagaaccagtagagcggccacatgatgccgtacttgacccacgtaggcaccggtgcagggtcgatgtacgtcgacgcgacgtagagcagggacatgaccgcgatgtcaaaggccaggtacatgctgctacgaagcgccgagcgctcgaaacagtgcgcggggatggccttgcgcagcgtcccgatcgtgaacggaggcttctccacaggctgcctgttcgtcttgatagccatctcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctgtagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 165 - DNA, 595 bp, Artificial Sequence; identical to SEQ ID NO: 163
  synthesized construct

SEQ ID NO: 166 - DNA, 5348 bp, Artificial Sequence
  synthesized construct
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccaggtgtgtttgagggttttggttgcccgtattgaggtcctggtggcgcgcatggaggagaaggcgcctgtcccgctgacccccccggctaccctcccggcaccttccagggcgcgtacgggaagaaccagtagagcggccacatgatgccgtacttgacccacgtaggcaccggtgcagggtcgatgtacgtcgacgcgacgtagagcagggacatgaccgcgatgtcaaaggccaggtacatgctgctacgaagcgccgagcgctcgaaacagtgcgcggggatggccttgcgcagcgtcccgatcgtgaacggaggcttctccacaggctgcctgttcgtcttgatagccatctcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctgtagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 167 - DNA, 1220 bp, Artificial Sequence
  synthesized construct
actagttcacttgtggaaccagagcgcggagtcgtcctcgggcgcgtccgggacgacgtagcggcagtcgcgccagtcctcccacagggcgcggccgacccagcggctgtcggactggtagtacttgcccaggatgggcctgatggcggcggaggcctcctcggcgtggtagtgcgggatggtgctgaagaggtggtgcagcacgtgggtgtcggagatgtggtgcaggatgttgtccatgaagggcgggcccatggagcggtccacggtggccatggcgccgcgcagccagtcccagtccttctcgaagtagtgcggcagcgccgggtgcgtgtgctggagcagcgtgatgagcacgagccacatgttcacgatcaggtagggcaccacgtaggtcttgaccagccaggcccagcccatggtgcggcccagcacgctgagcccgctgagcaccgccaccagcgccaggtcggagatgaccacctcgatgcgctcgcgcttgctgaagatgggcgaccacgggtcaaagtggttggcgaagcgcgggtacggccgcgaggcgacgttgaacatgaggtacagcggccagcccagggtcagggtgaccagcaccttgcccatgcggatgggcagccactcctcccactccaggccctcgtgcgccactgcgcggtgcggcggcacaaacacctcgtccttgtccaggcaccccgtgttggagtggtggcggcggtgcgagtgcttccaggagtagtagggcaccagcagcaggctgtggaacaccaggcccacgccgtcgttgatggcctggctggaggaaaaggcctggtggccgcactcgtgcgcgcacacccagacacccgtgccgaaggcgccctggaaggtgccgggagggtagccgggggggtcagcgggacaggcgccttctcctccatgcgcgccaccaggacctcaatacgggcaaccaaaaccctcaaacacacctggaagaaccagtagagcggccacatgatgccgtacttgacccacgtaggcaccggtgcagggtcgatgtacgtcgacgcgacgtagagcagggacatgaccgcgatgtcaaaggccaggtacatgctgctacgaagcgccgagcgctcgaaacagtgcgcggggatggccttgcgcagcgtcccgatcgtgaacggaggcttctccacaggctgcctgttcgtcttgatagccat

SEQ ID NO: 168 - DNA, 6726 bp, Artificial Sequence
  synthesized construct
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagttcacttgtggaaccagagcgcggagtcgtcctcgggcgcgtccgggacgacgtagcggcagtcgcgccagtcctcccacagggcgcggccgacccagcggctgtcggactggtagtacttgcccaggatgggcctgatggcggcggaggcctcctcggcgtggtagtgcgggatggtgctgaagaggtggtgcagcacgtgggtgtcggagatgtggtgcaggatgttgtccatgaagggcgggcccatggagcggtccacggtggccatggcgccgcgcagccagtcccagtccttctcgaagtagtgcggcagcgccgggtgcgtgtgctggagcagcgtgatgagcacgagccacatgttcacgatcaggtagggcaccacgtaggtcttgaccagccaggcccagcccatggtgcggcccagcacgctgagcccgctgagcaccgccaccagcgccaggtcggagatgaccacctcgatgcgctcgcgcttgctgaagatgggcgaccacgggtcaaagtggttggcgaagcgcgggtacggccgcgaggcgacgttgaacatgaggtacagcggccagcccagggtcagggtgaccagcaccttgcccatgcggatgggcagccactcctcccactccaggccctcgtgcgccactgcgcggtgcggcggcacaaacacctcgtccttgtccaggcaccccgtgttggagtggtggcggcggtgcgagtgcttccaggagtagtagggcaccagcagcaggctgtggaacaccaggcccacgccgtcgttgatggcctggctggaggaaaaggcctggtggccgcactcgtgcgcgcacacccagacacccgtgccgaaggcgccctggaaggtgccgggagggtagccgggggggtcagcgggacaggcgccttctcctccatgcgcgccaccaggacctcaatacgggcaaccaaaaccctcaaacacacctggaagaaccagtagagcggccacatgatgccgtacttgacccacgtaggcaccggtgcagggtcgatgtacgtcgacgcgacgtagagcagggacatgaccgcgatgtcaaaggccaggtacatgctgctacgaagcgccgagcgctcgaaacagtgcgcggggatggccttgcgcagcgtcccgatcgtgaacggaggcttctccacaggctgcctgttcgtcttgatagccatctcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctgtagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 169 - DNA, 1220 bp, Artificial Sequence; identical to SEQ ID NO: 167
  synthesized construct

SEQ ID NO: 170 - DNA, 5973 bp, Artificial Sequence
  synthesized construct
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagttcacttgtggaaccagagcgcggagtcgtcctcgggcgcgtccgggacgacgtagcggcagtcgcgccagtcctcccacagggcgcggccgacccagcggctgtcggactggtagtacttgcccaggatgggcctgatggcggcggaggcctcctcggcgtggtagtgcgggatggtgctgaagaggtggtgcagcacgtgggtgtcggagatgtggtgcaggatgttgtccatgaagggcgggcccatggagcggtccacggtggccatggcgccgcgcagccagtcccagtccttctcgaagtagtgcggcagcgccgggtgcgtgtgctggagcagcgtgatgagcacgagccacatgttcacgatcaggtagggcaccacgtaggtcttgaccagccaggcccagcccatggtgcggcccagcacgctgagcccgctgagcaccgccaccagcgccaggtcggagatgaccacctcgatgcgctcgcgcttgctgaagatgggcgaccacgggtcaaagtggttggcgaagcgcgggtacggccgcgaggcgacgttgaacatgaggtacagcggccagcccagggtcagggtgaccagcaccttgcccatgcggatgggcagccactcctcccactccaggccctcgtgcgccactgcgcggtgcggcggcacaaacacctcgtccttgtccaggcaccccgtgttggagtggtggcggcggtgcgagtgcttccaggagtagtagggcaccagcagcaggctgtggaacaccaggcccacgccgtcgttgatggcctggctggaggaaaaggcctggtggccgcactcgtgcgcgcacacccagacacccgtgccgaaggcgccctggaaggtgccgggagggtagccgggggggtcagcgggacaggcgccttctcctccatgcgcgccaccaggacctcaatacgggcaaccaaaaccctcaaacacacctggaagaaccagtagagcggccacatgatgccgtacttgacccacgtaggcaccggtgcagggtcgatgtacgtcgacgcgacgtagagcagggacatgaccgcgatgtcaaaggccaggtacatgctgctacgaagcgccgagcgctcgaaacagtgcgcggggatggccttgcgcagcgtcccgatcgtgaacggaggcttctccacaggctgcctgttcgtcttgatagccatctcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctgtagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 171 - DNA, 1221 bp, Artificial Sequence
  synthesized construct
actagtatggccaccgcatccactttctcggcgttcaatgcccgctgcggcgacctgcgtcgctcggcgggctccgggccccggcgcccagcgaggcccctccccgtgcgcgggcgcgccgaggtgcacgtgcaggtgacccactccctggcccccgagaagcgcgagatcttcaactccctgaacaactgggcccaggagaacatcctggtgctgctgaaggacgtggacaagtgctggcagccctccgacttcctgcccgactccgcctccgagggcttcgacgagcaggtgatggagctgcgcaagcgctgcaaggagatccccgacgactacttcatcgtgctggtgggcgacatgatcaccgaggaggccctgcccacctaccagaccatgctgaacaccctggacggcgtgcgcgacgagaccggcgcctccctgaccccctgggccatctggacccgcgcctggaccgccgaggagaaccgccacggcgacctgctgaacaagtacctgtacctgtccggccgcgtggacatgaagcagatcgagaagaccatccagtacctgatcggctccggcatggacccccgcaccgagaacaacccctacctgggcttcatctacacctccttccaggagcgcgccaccttcatctcccacggcaacaccgcccgcctggccaaggagcacggcgacctgaagctggcccagatctgcggcatcatcgccgccgacgagaagcgccacgagaccgcctacaccaagatcgtggagaagctgttcgagatcgaccccgacggcaccgtgctggccctggccgacatgatgcgcaagaaggtgtccatgcccgcccacctgatgtacgacggccaggacgacaacctgttcgagaacttctcctccgtggcccagcgcctgggcgtgtacaccgccaaggactacgccgacatcctggagttcctggtgggccgctgggacatcgagaagctgaccggcctgtccggcgagggccgcaaggcccaggactacgtgtgcaccctgcccccccgcatccgccgcctggaggagcgcgcccagtcccgcgtgaagaaggcctccgccacccccttctcctggatcttcggccgcgagatcaacctgatggactacaaggaccacgacggcgactacaaggaccacgacatcgactacaaggacgacgacgacaagtgaatcgat

SEQ ID NO: 172 - protein, 390 aa, Olea europaea
MALKLCFPPHKMPSFPDARIRSHRVFMASTIHSPSMEVGKVKKPFTPPREVHVQVTHSLAPEKREIFNSLNNWAQENILVLLKDVDKCWQPSDFLPDSASEGFDEQVMELRKRCKEIPDDYFIVLVGDMITEEALPTYQTMLNTLDGVRDETGASLTPWAIWTRAWTAEENRHGDLLNKYLYLSGRVDMKQIEKTIQYLIGSGMDPRTENNPYLGFIYTSFQERATFISHGNTARLAKEHGDLKLAQICGIIAADEKRHETAYTKIVEKLFEIDPDGTVLALADMMRKKVSMPAHLMYDGQDDNLFENFSSVAQRLGVYTAKDYADILEFLVGRWDIEKLTGLSGEGRKAQDYVCTLPPRIRRLEERAQSRVKKASATPFSWIFGREINL

SEQ ID NO: 173 - DNA, 1254 bp, Artificial Sequence
  synthesized construct
actagtatgggcggcggcggccgcatgtccaccgtgatcacctccaacaactccgagaagaagggcggctcctcccacctgaagcgcgccccccacaccaagccccccttcaccctgggcgacctgaagcgcgccatccccccccactgcttcgagcgctccttcgtgcgcgggcgcgcctccttctcctacgtggcctacgacgtgtgcctgtccttcctgttctactccatcgccaccaacttcttcccctacatctcctcccccctgtcctacgtggcctggctggtgtactggctgttccagggctgcatcctgaccggcctgtgggtgatcggccacgagtgcggccaccacgccttctccgagtaccagctggccgacgacatcgtgggcctgatcgtgcactccgccctgctggtgccctacttctcctggaagtactcccaccgccgccaccactccaacatcggctccctggagcgcgacgaggtgttcgtgcccaagtccaagtccaagatctcctggtactccaagtactccaacaacccccccggccgcgtgctgaccctggccgccaccctgctgctgggctggcccctgtacctggccttcaacgtgtccggccgcccctacgaccgcttcgcctgccactacgacccctacggccccatcttctccgagcgcgagcgcctgcagatctacatcgccgacctgggcatcttcgccaccaccttcgtgctgtaccaggccaccatggccaagggcctggcctgggtgatgcgcatctacggcgtgcccctgctgatcgtgaactgcttcctggtgatgatcacctacctgcagcacacccaccccgccatcccccgctacggctcctccgagtgggactggctgcgcggcgccatggtgaccgtggaccgcgactacggcgtgctgaacaaggtgttccacaacatcgccgacacccacgtggcccaccacctgttcgccaccgtgccccactaccacgccatggaggccaccaaggccatcaagcccatcatgggcgagtactaccgctacgacggcacccccttctacaaggccctgtggcgcgaggccaaggagtgcctgttcgtggagcccgacgagggcgcccccacccagggcgtgttctggtaccgcaacaagtacatggactacaaggaccacgacggcgactacaaggaccacgacatcgactacaaggacgacgacgacaagtgaatcgat

SEQ ID NO: 174 - protein, 387 aa, Ricinus communis
MGGGGRMSTVITSNNSEKKGGSSHLKRAPHTKPPFTLGDLKRAIPPHCFERSFVRSFSYVAYDVCLSFLFYSIATNFFPYISSPLSYVAWLVYWLFQGCILTGLWVIGHECGHHAFSEYQLADDIVGLIVHSALLVPYFSWKYSHRRHHSNIGSLERDEVFVPKSKSKISWYSKYSNNPPGRVLTLAATLLLGWPLYLAFNVSGRPYDRFACHYDPYGPIFSERERLQIYIADLGIFATTFVLYQATMAKGLAWVMRIYGVPLLIVNCFLVMITYLQHTHPAIPRYGSSEWDWLRGAMVTVDRDYGVLNKVFHNIADTHVAHHLFATVPHYHAMEATKAIKPIMGEYYRYDGTPFYKALWREAKECLFVEPDEGAPTQGVFWYRNKY

SEQ ID NO: 175 - protein, 535 aa, Ricinus communis
MSVTCSKENRHAFFSSSTPGTTSSHSRTRRRPKYNSISTPASQSFFNSLSSSGSSFQQLMSSCLAFEPCSHYYSSNGLFPNTPLLPKRHPRLHHRLPRSGEAMAVAVQPEKEVATNKKPLMKQRRVVVTGMGVVSPLGHDIDVYYNNLLDGSSGISQIDSFDCAQFPTRIAGEIKSFSTDGWVAPKLSKRMDKFMLYMLTAGKKALADGGITEDMMDELDKARCGVLIGSAMGGMKVFNDAIEALRISYRKMNPFCVPFATTNMGSAMLAMDLGWMGPNYSISTACATSNFCILNAANHIIRGEADIMLCGGSDAAIIPIGLGGFVACRALSQRNDDPTKASRPWDMNRDGFVMGEGAGVLLLEELEHAKKRGANIYAEFLGGSFTCDAYHMTEPRPDGVGVILCIEKALARSGVSKEEVNYINAHATSTPAGDLKEYEALMRCFSQNPDLRVNSTKSMIGHLLGAAGAVEAIATIQAIRTGWVHPNINLENPEEGVDTKVLVGPKKERLDIKVALSNSFGFGGHNSSIIFAPYK

SEQ ID NO: 176 - protein, 491 aa, Helianthus annus
MAASMVCTWIVAACMSVSSSSSSNSLFSSKRKRRLDRFSLSSRCRRGGRVAMAIAIQPSSIEMEEETTLTKRKQPPTKQRRVVVTGMGVETPIGNNPDQFYNNLLQGVSGITQIEAFDCSSYPTRIAGEIKNFSTDGWVAPKLSKRMDRFMLYMLTAGKKALADAGISPSDSDEIDKSRCGVLIGSAMGGMKVFNDAIEALRVSYRKMNPFCVPFATTNMGSAMLAMDLGWMGPNYSISTACATSNFCILNAANHIIRGEADMMLCGGSDAVIIPIGLGGFVACRALSERNTDPAKASRPWDSGRDGFVMGEGAGVLLLEELEHAKKRGAKIYAEFLGGSFTCDAYHMTEPHPEGAGVILCIEKALSQAGVRREDVNYINAHATSTPAGDLKEYHALLHCFGNNQELRVNSTKSMIGHLLGAAGAVEAVATVQAIRTGWIHPNINLENPDQGVDTKVLVGSKKERLNVKVGLSNSFGFGGHNSSILFAPFQ

SEQ ID NO: 177 - protein, 433 aa, Brassica napus
MAVAMDMEKEAKVDNKPPTEQRRVVVTGMGVETSLGHDPDTFYENLLQGNSGISQIENFDCSAFPTRIAGEIKSFSTEGWVAPKLSKRMDKFMLYLLTAGKKALVDGGVTEEVMAEFDKAKCGVLIGSAMGGMKVFQDAIEAMKISYKKMNPFCVPFATTNMGSAMLALDLGWMGPNYSISTACATSNFCILNSANHIIKGEADVMLCGGSDSVIIPIGLGGFVACRALSQRNNDPTKASRPWDSNRDGFVMGEGAGVLLLEELEHAKKRGATIYAEFLGGSFTCDAYHMTEPRPDGAGVILCIERALADAGISKEQINYINAHATSTPAGDLKEYQALAHCFGQNPEIKVNSTKSMIGHLLGAAGAVEAVATVQAIRTGWVHPNINLESPDNGVDTNLLVGPEKERLDIKAALSNSFGFGGHNSSIIFAPYK

SEQ ID NO: 178 - protein, 488 aa, Glycine max
MASTTTSSLCTWLVAACMSVTCHADRTKTPHAMFRSSKKSRYSQFNVCRSTHSGKTMAVALQPTQEITTIKKPPTKQRRVVVTGLGVVTPLGHEPDIFYNNLLDGASGISEIETFDCAEYPTRIAGEIKSFSTDGWVAPKLSKRMDKFMLYMLTAGKKALVDGGITDDVMDELNKEKCGVLIGSAMGGMKVFNDAIEALRISYKKMNPFCVPFATTNMGSAMLAMDLGWMGPNYSISTACATSNFCILNAANHIIRGEADVMLCGGSDAAIIPIGLGGFVACRALSQRNTDPTKASRPWDINRDGFVMGEGAGVLLLEELEHAKERGATIYAEFLGGSFTCDAYHVTEPRPDGAGVILCIEKALAQSGVSKEDVNYINAHATSTPAGDLKEYQALMHCFGQNPELRVNSTKSMIGHLLGAAGGVEAVATIQAIRTGWVHPNINLENPDNGVDAKVLVGSKKERLDVKAALSNSFGFGGHNSSIIFAPY

SEQ ID NO: 179 - protein, 467 aa, Prototheca moriformis
MQTAHQRPPTEGHCFGARLPTASRRAVRRAWSRIARAAAAADANPARPERRVVITGQGVVTSLGQTIEQFYSSLLEGVSGISQIQKFDTTGYTTTIAGEIKSLQLDPYVPKRWAKRVDDVIKYVYIAGKQALESAGLPIEAAGLAGAGLDPALCGVLIGTAMAGMTSFAAGVEALTRGGVRKMNPFCIPFSISNMGGAMLAMDIGFMGPNYSISTACATGNYCILGAADHIRRGDANVMLAGGADAAIIPSGIGGFIACKALSKRNDEPERASRPWDADRDGFVMGEGAGVLVLEELEHAKRRGATILAELVGGAATSDAHHMTEPDPQGRGVRLCLERALERARLAPERVGYVNAHGTSTPAGDVAEYRAIRAVIPQDSLRINSTKSMIGHLLGGAGAVEAVAAIQALRTGWLHPNLNLENPAPGVDPVVLVGPRKERAEDLDVVLSNSFGFGGHNSCVIFRKYDE

SEQ ID NO: 180 - protein, 400 aa, Prototheca moriformis
MASAVTFACAPPRGAVAAPGRRAASRPLVVRAVASEAPLGVPPSVQRPSPVVYSKLDKQHRLTPERLELVQSMGQFAEERVLPVLHPVDKLWQPQDFLPDPESPDFEDQVAELRARAKDLPDEYFVVLVGDMITEEALPTYMAMLNTLDGVRDDTGAADHPWARWTRQWVAEENRHGDLLNKYCWLTGRVNMRAVEVTINNLIKSGMNPQTDNNPYLGFVYTSFQERATKYSHGNTARLAAEHGDKNLSKICGLIASDEGRHEIAYTRIVDEFFRLDPEGAVAAYANMMRKQITMPAHLMDDMGHGEANPGRNLFADFSAVAEKIDVYDAEDYCRILEHLNARWKVDERQVSGQAAADQEYVLGLPQRFRKLAEKTAAKRKRVARRPVAFSWISGREIMV

SEQ ID NO: 181 - protein, 378 aa, Linus usitatissimum
MGAGGRMPVPPSSKPMKRSPYSKPPFTLGELKKAIPPHCFKRSIPRSFAYVAHDLTIAAIFYYIATTYFHLLPSPLNYLAWPVYWACQGCILTGVWVLAHECGHHAFSDYQWLDDMDGFVLHSSLLVPYFSWKHSHRRHHSNTGSLDRDEVFVPKQKAEIGWYSKYLNNPPGRVITLAVTLTLGWPLYLAFNVSGRPYDRFACHFDPHGPIYNDRERMEIYLSDAGIFTVCYILYRLVLTKGLVWVVSIYGVPLLIVNGFLVLITFLQHTHPSLPHYKSSEWDWMRGALSTVDRDYGLLNTVFHNITDTHVAHHLFSTMPHYHAMEATKAIKPVLGEYYQFDGTPFVKAMWREAKECIYVEPDEGDPSQGVFWYNNKL

SEQ ID NO: 182 - protein, 391 aa, Linus usitatissimum
MSPPNSMSPTTNGNGVAMNGAKKQLDFDPSAAPPFKIADIRAAIPPHCWVKNPWRSLSYVLRDLLVILSFAVAAAKLDSWTFWPLYWVAQGTMFWAVFVLGHDCGHGSFSDIWLLNNVMGHILHSSILVPYHGWRISHKTHHQNHGNVEKDESWVPLPEKVYKSLDTSTKFMRFTIPLPMFAYPIYLWTRSPGKKGSHFNPYSDLFAPNERAAVLISTLCWTAMALLLCYSSFIYGFAPVLKIYGVPYLIFVAWLDMVTYLHHHGYEQKLPWYRGKEWSYLRGGLTTVDRDYGVINNIHHDIGTHVIHHLFPQMPHYHLVEATQAAKHVLGKYYREPKKSGPFPFHLFGYLVRSLGEDHYVSDTGDVVFYQSDPHIPKFRTSSATTKSKSS

SEQ ID NO: 183 - protein, 392 aa, Linus usitatissimum
MSPPNSMSPATNGSTNGVAINGAKKLLDFDPSAAPPFKIADIRAAIPPHCWVKNPWRSLSYVLRDLLVILSFAVAATKLDSWTVWPLYWIAQGTMFWAVFVLGHDCGHGSFSDSWLLNNVMGHILHSSILVPYHGWRISHKTHHQNHGNVEKDESWVPLPEKVYKSLDTGTKFMRFTIPLPMFAYPIYLWRRSPGKKGSHFNPYSDLFAPNERTSVMISTLCWTAMALLLCYSSFIYGFLPVFKIYGVPYLIFVAWLDMVTYLHHHGYEQKLPWYRGKEWSYLRGGLTTVDRDYGVINNIHHDIGTHVIHHLFPQMPHYHLVEATQAAKHVLGKYYREPKKSGPFPFHLFGYLVRSLGEDHYVSDTGDVVFYQSDPHIPKFPTSATTKSKSS

SEQ ID NO: 184 - protein, 383 aa, Carthamus tinctorus
MGAGGRMSNPSEGEKKTELEGIQRVPYQKPPFTVGDVKKAIPPHCFNRSVIRSFSYVVYDLTIASILYYIATTFIPLLPHPLAYVAWPIYWAVQGCVMTGVWVIAHECGHHAFSDYQWLDDTVGLILHSVLLVPYFSWKYSHRRHHSNTGSIEHDEVFVPKLKSGVRSTAKYLNNPPGRILTLLVTLTLGWPLYLMFNVSGRYYDRFACHFDPNSPIYSNRERAQIFISDAGIFAVLYGLYRLAAVKGLVWVLTVYAGPLLVVNGFLVLITFLQHTHPSLPHYDSTEWDWLRGALATIDRDYGILNKVFHNITDTHVTHHLFSTMPHYHAMEATKAIIPILGDYYQFDGTSVFKAMYRETKECIYVDKDEEVKDGVYWYRNKI

SEQ ID NO: 185 - protein, 382 aa, Helianthus annus
MGAGGRMSSPNGKEKDGPKPLERALHEKPPFTVGDIKKVIPPHCFKRSVIRSFSYVVYDLTIASIFYYLANNYIPLLPNSLAYVAWPVYWIFQGCVLTGVWVIAHECGHHAFSDYQWLDDTVGLILHSALLVPYFSWKYSHRRHHSNTGSIEHDEVFVPKLKSSVRSTAKYLNNPPGRILTLLVTLTMGWPLYLMFNVSGRYYDRFACHFDPNSPIYSNRERAQIFISDAGILTVFYILFRLASTKGLVWVLTMYGGPLLVVNGFLVLITFLQHTHPSLPHYDSTEWDWLRGALATVDRDYGILNKVFHNITDTHVTHHLFSTMPHYHAMEATKAIKPILGDYYQFDGTSIFKAMYRETKECIYVDKDEDVKDGVYWYRNKI

SEQ ID NO: 186 - protein, 397 aa, Cuphea wrightii
MVAAAASSAFFSVPTPGTSPKPGKFGNWPSSLSVPFKPDNGGFVKANASAHPKANGSAVNLKSGSLETPPRSFINQLPDLSMLLSKITTVFGAAEKQWKRPGMLVEPFGVDRIFQDGVFFRQSFSIRSYEIGVDRTASIETLMNIFQETSLNHCKSIGLLNDGFGRTPEMCKRDLIWVVTKIQVEVNRYPTWGDTIEVNTWVSESGKNGMGRDWLISDCRTGEILIRATSVWAMMNQNTRRLSKFPYEVRQEIAPHFVDSAPVIEDDRKLHKLDVKTGDSIRDGLTPRWNDLDVNQHVNNVKYIGWILKSVPIEVFETQELCGVTLEYRRECGRDSVLESVTTMDPAKEGDRCVYQHLLRLEDGADITIGRTEWRPKNAGANGAISSGKTSNGNSVS

SEQ ID NO: 187 - protein, 408 aa, Cuphea wrightii
MVVAAAASSAFFPVPAPRPTPKPGKFGNWPSSLSQPFKPKSNPNGRFQVKANVSPHPKANGSAVSLKSGSLNTLEDPPSSPPPRTFLNQLPDWSRLRTAITTVFVAAEKQFTRLDRKSKRPDMLVDWFGSETIVQDGLVFRERFSIRSYEIGADRTASIETLMNHLQDTSLNHCKSVGLLNDGFGRTPEMCTRDLIWVLTKMQIVVNRYPTWGDTVEINSWFSQSGKIGMGREWLISDCNTGEILVRATSAWAMMNQKTRRFSKLPCEVRQEIAPHFVDAPPVIEDNDRKLHKFDVKTGDSICKGLTPGWNDFDVNQHVSNVKYIGWILESMPTEVLETQELCSLTLEYRRECGRESVVESVTSMNPSKVGDRSQYQHLLRLEDGADIMKGRTEWRPKNAGTNRAIST

SEQ ID NO: 188 - DNA, 5975 bp, Artificial Sequence
  synthesized construct
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagcatattcaaacacctagatcactaccacttctacacaggccactcgagcttgtgatcgcactccgctaagggggcgcctcttcccttcgtttcagtcacaacccgcaaacggcgcgccatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtatggtggccgccgccgccagcagcgccttcttcagcgtgcccacccccggcaccagccccaagcccggcaagttcggcaactggcccagcagcctgagcgtgcccttcaagcccgacaacggcggcttccacgtgaaggccaacgccagcgcccacgggcgcgcccccaaggccaacggcagcgccgtgaacctgaagtccggcagcctggagacccccccccgcagcttcatcaaccagctgcccgacctgagcatgctgctgagcaagatcaccaccgtgttcggcgccgccgagaagcagtggaagcgccccggcatgctggtggagcccttcggcgtggaccgcatcttccaggacggcgtgttcttccgccagagcttcagcatccgcagctacgagatcggcgtggaccgcaccgccagcatcgagaccctgatgaacatcttccaggagaccagcctgaaccactgcaagagcatcggcctgctgaacgacggcttcggccgcacccccgagatgtgcaagcgcgacctgatctgggtggtgaccaagatccaggtggaggtgaaccgctaccccacctggggcgacaccatcgaggtgaacacctgggtgagcgagagcggcaagaacggcatgggccgcgactggctgatcagcgactgccgcaccggcgagatcctgatccgcgccaccagcgtgtgggccatgatgaaccagaacacccgccgcctgagcaagttcccctacgaggtgcgccaggagatcgccccccacttcgtggacagcgcccccgtgatcgaggacgaccgcaagctgcacaagctggacgtgaagaccggcgacagcatccgcgacggcctgaccccccgctggaacgacctggacgtgaaccagcacgtgaacaacgtgaagtacatcggctggattctgaagtccgtgcccatcgaggtgttcgagacccaggagctgtgcggcgtgaccctggagtaccgccgcgagtgcggccgcgacagcgtgctggagagcgtgaccaccatggaccccgccaaggagggcgaccgctgcgtgtaccagcacctgctgcgcctggaggacggcgccgacatcaccatcggccgcaccgagtggcgccccaagaacgccggcgccaacggcgccatcagcagcggcaagaccagcaacggcaacagcgtgagctgattaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 189 - DNA, 1256 bp, Artificial Sequence
  synthesized construct
actagtatggtggtggccgccgccgccagcagcgccttcttccccgtgcccgccccccgccccacccccaagcccggcaagttcggcaactggcccagcagcctgagccagcccttcaagcccaagagcaaccccaacggccgcttccaggtgaaggccaacgtgagcccccacgggcgcgcccccaaggccaacggcagcgccgtgagcctgaagtccggcagcctgaacaccctggaggacccccccagcagcccccccccccgcaccttcctgaaccagctgcccgactggagccgcctgcgcaccgccatcaccaccgtgttcgtggccgccgagaagcagttcacccgcctggaccgcaagagcaagcgccccgacatgctggtggactggttcggcagcgagaccatcgtgcaggacggcctggtgttccgcgagcgcttcagcatccgcagctacgagatcggcgccgaccgcaccgccagcatcgagaccctgatgaaccacctgcaggacaccagcctgaaccactgcaagagcgtgggcctgctgaacgacggcttcggccgcacccccgagatgtgcacccgcgacctgatctgggtgctgaccaagatgcagatcgtggtgaaccgctaccccacctggggcgacaccgtggagatcaacagctggttcagccagagcggcaagatcggcatgggccgcgagtggctgatcagcgactgcaacaccggcgagatcctggtgcgcgccaccagcgcctgggccatgatgaaccagaagacccgccgcttcagcaagctgccctgcgaggtgcgccaggagatcgccccccacttcgtggacgccccccccgtgatcgaggacaacgaccgcaagctgcacaagttcgacgtgaagaccggcgacagcatctgcaagggcctgacccccggctggaacgacttcgacgtgaaccagcacgtgagcaacgtgaagtacatcggctggattctggagagcatgcccaccgaggtgctggagacccaggagctgtgcagcctgaccctggagtaccgccgcgagtgcggccgcgagagcgtggtggagagcgtgaccagcatgaaccccagcaaggtgggcgaccgcagccagtaccagcacctgctgcgcctggaggacggcgccgacatcatgaagggccgcaccgagtggcgccccaagaacgccggcaccaaccgcgccatcagcacctgattaattaactcgag

SEQ ID NO: 190 - DNA, 1370 bp, Artificial Sequence
  synthesized construct
gaattcggcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagt

SEQ ID NO: 191 - DNA, 120 bp, Artificial Sequence; identical to SEQ ID NO: 49
  synthesized construct

SEQ ID NO: 192 - DNA, 114 bp, Artificial Sequence
  synthesized construct
actagtatggcttccgcggcattcaccatgtcggcgtgccccgcgatgactggcagggcccctggggcacgtcgctccggacggccagtcgccacccgcctgagggggcgcgcc

SEQ ID NO: 193 - DNA, 120 bp, Artificial Sequence; identical to SEQ ID NO: 48
  synthesized construct

SEQ ID NO: 194 - DNA, 117 bp, Artificial Sequence
  synthesized construct
actagtatgacgttcggggtcgccctcccggccatgggccgcggtgtctcccttccccggcccagggtcgcggtgcgcgcccagtcggcgagtcaggttttggagagcgggcgcgcc

SEQ ID NO: 195 - protein, 385 aa, Carthamus tinctorius
MLSKGAPAAPAVAAMYNASAKDTTFALTHSRSIGSVSIRRRYNVFLCNSSSSSRKVSPLLAVATGEQPSGVASLREADKEKSLGNRLRLGSLTEDGLSYKEKFVIRCYEVGINKTATIETIANLLQEVGGNHAQGVGFSTDGFATTTTMRKLHLIWVTARMHIEIYRYPAWSDVIEIETWVQGEGKVGTRRDWILKDYANGEVIGRATSKWVMMNEDTRRLQKVSDDVREEYLVFCPRTLRLAFPEENNNSMKKIPKLEDPAEYSRLGLVPRRSDLDMNKHVNNVTYIGWALESIPPEIIDTHELQAITLDYRRECQRDDIVDSLTSREPLGNAAGVKFKEINGSVSPKKDEQDLSRFMHLLRSAGSGLEINRCRTEWRKKPAKR

SEQ ID NO: 196 - protein, 395 aa, Ricinus communis
MALKLNRLTFPPTHKLPSQSPFQRSPNRVFMAATVGSTSTKEVENLKKPFSPPREVHVQVTHSMPPQKMEIFKSLEGWAEDNILVHLKPVEKCWQPQDFLPDPESEGFYEQVKELRERARELPDDYFVVLVGDMITEEALPTYQTMLNTLDGVRDETGASLTSWAIWTRAWTAEENRHGDLLNKYLYLSGRVDMKHIEKTIQYLIGSGMDPKTENNPYLGFIYTSFQERATFISHGNTARLAKEHGDMKLAQICGIIAADEKRHETAYTKIAEKLFEIDPDGTVMALADMMRKKISMPAHLMFDGQDDNLFDHYSSVAQRIGVYTAKDYADILEFLVGRWKVENLIGLSGEGRRAQDFVCGLPGRIRRLEERAQGRAKQAATVPFSWIFGRELKL

SEQ ID NO: 197 - protein, 396 aa, Helianthus annus
MAIRINTATFQSDLYRSFAFPQPKPLRSPKFAMASTIGSATTKVESTKKPFTPPREVHQQVLHSMPPQKIEIFKSMEGWAEDNILVHLKPVEKCWQAQDFLPDPASDGFMEQVEELRARAKEIPDDYFVVLVGDMITEEALPTYQTMLNTLDGVRDETGASPTSWAIWTRAWTAEENRHGDLLHQYLYLSGRVDMRQIQKTIQYLIGSGMDPRTENSPYLGFIYTSFQERATFISHGNTARHAKEHGDVKLAQMCGIIAADEKRHETAYTKIVEKLFEIDPDGTVLAFADMMRKKISMPAHLMYDGRDDNLFENFSAVAQRLGVYTAKDYADILEFLVGRWKVADLTGLSGEGRKAQDYVCGLAPRIRRLEERNSARAKESVNVPFSWIFDREVKL

SEQ ID NO: 198 - protein, 401 aa, Brassica juncea
MALKLNPLASQPYNFPSSARPPISTFRSPKFLCLASSSSPALSSSTKEVESLKKPFTPPKEVHVQVLHSMPPQKIEIFKSMEDWAEQNLLTHLKDVEKSWQPQDFLPDPASDGFEDQVKELRERARELPDDYFVVLVGDMITEEALPTYQTMLNTLDGVRDETGASPTPWAVWTRAWTAEENRHGDLLNKYLYLSGRVDMRQIEKTIQYLIGSGMDPRTENNPYLGFIYTSFQERATFVSHGNTARQAKEHGDLKLAQICGTIAADEKRHETAYTKIVEKLLEIDPDGTVVAFADMMRKKISMPAHLMYDGRDDNLFDNFSSVAQRLGVYTAKDYADILEFLAGRWKIESLSGLSGEGNKAQEYLCGLTPRIRRLDERAQARAKKGPKIPFSWIHDREVQL

SEQ ID NO: 199 - protein, 391 aa, Glycine max
MALRLNPIPTQTFSLPQMASLRSPRFRMASTLRSGSKEVENIKKPFTPPREVHVQVTHSMPPQKIEIFKSLEDWAEQNILTHLKPVEKCWQPQDFLPDPSSDGFEEQVKELRERAKELPDDYFVVLVGDMITEEALPTYQTMLNTLDGVRDETGASLTSWAIWTRAWTAEENRHGDLLNKYLYLSGRVDMKQIEKTIQYLIGSGMDPRTENSPYLGFIYTSFQERATFISHGNTARLAKEHGDIKLAQICGMIASDEKRHETAYTKIVEKLFEVDPDGTVMAFADMMRKKIAMPAHLMYDGRDDNLFDSYSSVAQRIGVYTAKDYADILEFLVGRWKVEQLTGLSGEGRKAQEYICGLPPRIRRLEERAQARVKESSTLKFSWIHDREVLL

SEQ ID NO: 200 - protein, 390 aa, Olea europaea; identical to SEQ ID NO: 172

SEQ ID NO: 201 - protein, 392 aa, Vernicia fordii
MALKLNPFISQSHKFPTFALPPMANLRSPKFYMASTLREIEHLKKPFMPPREVHVQVTHSMPPQKIEIFKSLEDWAEQNILVHLKPVEKCWQPQDFLPDPASDDFDEQVKELRERAKEIPDDYFVVLVGDMITEEALPTYQTMLNTLDGVRDETGASLTSWAIWTRAWTAEENRHGDLLNKYLYLSGRVDMRQIEKTIQYLIGSGMDPRTENSPYLGFIYTSFQERATFISHGNTARHAKEHGDIKLAQICGTIASDEKRHETAYTKIVEKLFEIDPNGTVLAFADMMRKKISMPAHLMYDGCNDNLFDHFSAVAQRLGVYTAKDYADILEFLVGRWKVDKLMGLSAEGQKAQDYVCRLPPRIRRLEERAQGRAKEATIVPFSWIFEREVQL

SEQ ID NO: 202 - protein, 365 aa, Helinathus annus
MLSRGVPTATATAYNDVIKETARSVTNSRSIDSVSIRRRNNGFVSNSLCRRVAPVMAVKVDEQRTGVAVDVTEKRLADRLRMGSLTEDGLSYKERFIIRCYEVGINKTATVETIANLLQEVGGNHAQSVGFSTDGFATTTTMRKLNLIWVTSRMHIEIYRYPAWSDVVEIETWCQGEGRIGTRRDWIIKDHANGEVIGRATSKWVMMNSETRRLQKVNDDIRDEYLIFCPKTLRLAFPEENNNSLKKIAKLEDPAECSTLGLVPRRADLDMNKHVNNVTYIGWVLESIPQEVIDTHELQTITLDYRRECQHDDVVDSLTSSESPAVNGCASGENLSKFLHLLRSSGEGLELNRGRTEWRKKPAKK

SEQ ID NO: 203 - protein, 362 aa, Brassica rapa
MLKLSCNATDKLQTLFSHSHQPDPAHRRTVSSVSCSHLRKPVLDPLRAIVSADQGSVIRAEQGLGSLADQLRLGSLTEDGLSYKEKFIVRSYEVGSNKTATVETVANLLQEVGCNHAQSVGFSTDGFATTPTMRKLHLIWVTARMHIEIYKYPAWGDVVEIETWCQSEGRIGTRRDWILKDVATGEVTGRATSKWVMMNQDTRRLQKVSDDVRDEYLVFCPKELRLAFPEENNRSLKKIPKLEDPAQYSMIGLKPRRADLDMNQHVNNVTYIGWVLESIPQEIVDTHELQVITLDYRRECQQDDVVDSLTTTTSEIGGTNGSASSGTQGQNDSQFLHLLRLSGDGQEINRGTTLWRKKPSNL

SEQ ID NO: 204 - protein, 369 aa, Jatropha curcas
MMLKVPCTAPDQIQSLAPQCRFLNQHRSSSHFTRRRANAVVYSSPVAKISTQPVVSDGVTKVESGCESLADRLRLGHLTEDGFSYKEKFIVRSYEVGINKTATVETIANFLQEVGCNHAQSVGFSTDGFATTPTMRKLHLIWVTARMHIEIYKYPAWSDVVEIETWCQSEGRIGTRRDWILKDYATGQVIGRATSKWVMMNQDTRRLQKVTDDVRDEYLVFCPRELRLAFPEENNRSLKKISKLEDTTQYSKLGLVPRRADLDMNQHVNNVTYIGWVLESMPQEIIDTHELQTITLDYRRECQHDDVVDSLTSAESLEGAGLDLHATNGSATAIAGEQDSRNFLHLLRFSSDGLEINRGRTEWRKKPSR

SEQ ID NO: 205 - protein, 229 aa, Zea mays
MRKLGLIWVTNRMHIEIYKYPAWGDVVEIETWCQEDGKIGTRRDWILKDLCTGEVTGRATSKWVMMNQNTRRLQRVSDDVRDEVFIHCPKTPRLAFPEENNGSLKKIPNLSDPAQYSRLGLVPRRADLDMNQHVNNVTYIGWVLESIPQDIIDTHELQTITLDYRRECQHDDIVDSLTYVEEGEERSMNGSASSVPHTEQRRQFLHCLRFAANGDEINRGRTVWRKLAR

SEQ ID NO: 206 - protein, 366 aa, Zea mays
MLRCHTPPQCARAPLRHHGRWESPPAAAPAVVVRCARGAPQVSGIEAASPGHAAVTAALAKAEGGDARPSLAERLRLGNLLEDGLSYKESFIVRCYEVGINKTATVETIANLLQEVGCNHAQSVGFSTDGFATTTTMRKLGLIWVTNRMHIEIYKYPAWGDFVEIETWCQEDGRIGTRRDWILKDLANGEVIGRATSKWVMMNQNTRRLQRVSDDVRDEVFMHCPKAPRLAFPEENNGSLKKIPNLSDPAEYSRLGLVPRRADLDMNQHVNNVTYIGWVLESIPQDIIDTHELQTITLDYRRECQQDDIVDSLTCIEEGEEKSMNGSASAAAPHKEERQQFLHCLRFAANGHEINRGRTVWRKLAR

SEQ ID NO: 207 - protein, 381 aa, Carthamus tinctorius
MGAGGRMNVAVSGSEKPHAFKRVPVSKPPFELSDLKKAVPPHCFKRSLVRSFAALFRDIIIVTALYYLAATIIPVLPKPLTYVAWPLYWFFQGAYLMGLWVIGHECGHHGFSEYQWLDDTVGFIVHSFILTPYFGFKYSHRTHHANTNSIEYDEVWIPKRKSDKLYSEVLNNPLGSFIVFVFKIVLGFPLYFVFNLYGRKYEKGITSHFYPYSPIFNDSERFQIFLTDLGVFGTLYGVYRLALIKGTEWVINFYGMPILFMSGSFILLTYLHHTHPSIPHYDSTEWDWLRGALATVDRNFGFLNHAFHDATRTHAVHHLFPTIPHYHTFEARQAVMPILGDYYKYDDTPILQAIWRETKDCTFIEPEEVNGEKKGIYWFYK

SEQ ID NO: 208 - protein, 383 aa, Gossypium hirsutum
MGAGGRMSVPTSPKKPEFNSLKRVPYSKPPFTLSEIKKAIPPHCFQRSVLRSFSYLLYDFILASLFYHVATNYFPNLPQALSNVAWPLYWAMQGCILTGVWVIAHECGHHAFSDYQWLDDTVGLILHSSLLVPYFSWKYSHRRHHSNTGSLERDEVFVPKKKSGLRWWAKHFNNPPGRFLSITIQLTLGWPLYLAFNVAGRPYDRFACHYDPYGPIFSDRERLQIYISDAGVLAVAYALYRLVLAKGVGWVISVYGVPLLVVNAFLVMITYLQHTHPSLPHYDSSEWDWMRGALSTVDRDYGILNKVFHNITDTHVAHHLFSTMPHYHAMVATKAIKPILGEYYQFDGMPVYKAIWREAKECLYVEPDEGDKDKGVFWFRNKL

SEQ ID NO: 209 - protein, 383 aa, Glycine max
MGAGGRTDVPPANRKSEVDPLKRVPFEKPPFSLSQIKKVIPPHCFQRSVFRSFSYVVYDLTIAFCLYYVATHYFHLLPSPLSFLAWPIYWAVQGCILTGVWVIAHECGHHAFSDYQLLDDIVGLVLHSGLLVPYFSWKYSHRRHHSNTGSLERDEVFVPKQKSCIKWYSKYLNNPPGRVLTLAVTLTLGWPLYLALNVSGRPYDRFACHYDPYGPIYSDRERLQIYISDAGVLAVCYGLFRLAMAKGLAWVVCVYGVPLLVVNGFLVLITFLQHTHPALPHYTSSEWDWLRGALATVDRDYGILDKVFHNITDTHVAHELFSTMPHYHAMEATKAIKPILGEYYRFDETPFVKAMWREARECIYVEPDQSTESKGVFWYNNKL

SEQ ID NO: 210 - protein, 387 aa, Zea mays
MGAGGRMTEKEREKQEQLARATGGAAMQRSPVEKPPFTLGQIKKAIPPHCFERSVLKSFSYVVHDLVIAAALLYFALAIIPALPSPLGYAAWPLYWIAQGCVCTGVWVIAHECGHHAFSDYSLLDDVVGLVLHSSLMVPYFSWKYSHRRHHSNTGSLERDEVFVPKKKEALPWYTPYVYNNPVGRLAHIVVQLTLGWPLYLATNASGRPYPRFACHFDPYGPIYNDRERAQIFVSDAGVAAVAFGLYKLAAAFGVWWVVRVYAVPLLIVNAWLVLITYLQHTHPSLPHYDSSEWDWLRGALATMDRDYGILNRVFHNITDTHVAHHLFSTMPHYHAMEATKAIRPILGDYYHFDPTPVAKATWREAGECIYVEPEDRKGVFWYNKKF

SEQ ID NO: 211 - protein, 368 aa, Prototheca moriformis
MAIKTNRQPVEKPPFTIGTLRKAIPAHCFERSALRSSMYLAFDIAVMSLLYVASTYIDPAPVPTWVKYGVMWPLYWFFQGAFGTGVWVCAHECGHQAFSSSQAINDGVGLVFHSLLLVPYYSWKHSHRRHHSNTGCLDKDEVFVPPHRAVAHEGLEWEEWLPIRMGKVLVTLTLGWPLYLMFNVASRPYPRFANHFDPWSPIFSKRERIEVVISDLALVAVLSGLSVLGRTMGWAWLVKTYVVPYLIVNMWLVLITLLQHTHPALPHYFEKDWDWLRGAMATVDRSMGPPFMDNILHHISDTHVLHHLFSTIPHYHAEEASAAIRPILGKYYQSDSRWVGRALWEDWRDCRYVVPDAPEDDSALWFHK

SEQ ID NO: 212 - protein, 368 aa, Prototheca moriformis
MAIKTNRQPVEKPPFTIGTLRKAIPAHCFERSALRSSMYLAFDIAVMSLLYVASTYIDPAPVPTWVKYGIMWPLYWFFQGAFGTGVWVCAHECGHQAFSSSQAINDGVGLVFHSLLLVPYYSWKHSHRRHHSNTGCLDKDEVFVPPHRAVAHEGLEWEEWLPIRMGKVLVTLTLGWPLYLMFNVASRPYPRFANHFDPWSPIFSKRERIEVVISDLALVAVLSGLSVLGRTMGWAWLVKTYVVPYMIVNMWLVLITLLQHTHPALPHYFEKDWDWLRGAMATVDRSMGPPFMDSILHHISDTHVLHHLFSTIPHYHAEEASAAIRPILGKYYQSDSRWVGRALWEDWRDCRYVVPDAPEDDSALWFHK

SEQ ID NO: 213 - protein, 383 aa, Brassica napa
MVVAMDQRSNVNGDSGARKEEGFDPSAQPPFKIGDIRAAIPKHCWVKSPLRSMSYVTRDIFAVAALAMAAVYFDSWFLWPLYWVAQGTLFWAIFVLGHDCGHGSFSDIPLLNSVVGHILHSFILVPYHGWRISHRTHHQNHGHVENDESWVPLPEKLYKNLPHSTRMLRYTVPLPMLAYPIYLWYRSPGKEGSHFNPYSSLFAPSERKLIATSTTCWSIMLATLVYLSFLVDPVTVLKVYGVPYIIFVMWLDAVTYLHHHGHDEKLPWYRGKEWSYLRGGLTTIDRDYGIFNNIHHDIGTHVIHHLFPQIPHYHLVDATRAAKHVLGRYYREPKTSGAIPIHLVESLVASIKKDHYVSDTGDIVFYETDPDLYVYASDKSKIN

SEQ ID NO: 214 - protein, 448 aa, Camelina sativa
MANLVLSECGIRPLPRIYTTPRSNFVSNNNKPIFKFRPFTSYKTSSSPLACSRDGFGKNWSLNVSVPLTTTTPIVDESPLKEEEEEKQRFDPGAPPPFNLADIRAAIPKHCWVKNPWKSMSYVLRDVAIVFALAAGASYLNNWIVWPLYWLAQGTMFWALFVLGHDCGHGSFSNNPRLNNVVGHLLHSSILVPYHGWRISHRTHHQNHGHVENDESWHPMSEKIYQSLDKPTRFFRFTLPLVMLAYPFYLWARSPGKKGSHYHPESDLFLPKEKTDVLTSTACWTAMAALLICLNFVVGPVQMLKLYGIPYWINVMWLDFVTYLHHHGHEDKLPWYRGKEWSYLRGGLTTLDRDYGVINNIHHDIGTHVIHHLFPQIPHYHLVEATEAVKPVLGKYYREPDKSGPLPLHLLGILAKSIKEDHYVSDEGDVVYYKADPNMYGEIKVGAD

SEQ ID NO: 215 - protein, 448 aa, Camelina sativa
MANLVLSECGIRPLPRIYTTPRSNFVSNNNKPIFKFRPLTSYKTSSPLFCSRDGFGRNWSLNVSVPLATTTPIVDESPLEEEEEEEKQRFDPGAPPPFNLADIRAAIPKHCWVKNPWKSMSYVLRDVAIVFALAAGAAYLNNWIVWPLYWLAQGTMFWALFVLGHDCGHGSFSNNPRLNNVVGHLLHSSILVPYHGWRISHRTHHQNHGHVENDESWHPMSEKIYQSLDKPTRFFRFTLPLVMLAYPFYLWARSPGKKGSHYHPESDLFLPKEKTDVLTSTACWTAMAALLICLNFVVGPVQMLKLYGIPYWINVMWLDFVTYLHHHGHEDKLPWYRGKEWSYLRGGLTTLDRDYGVINNIHHDIGTHVIHHLFPQIPHYHLVEATEAVKPVLGKYYREPDKSGPLPLHLLGILAKSIKEDHYVSDEGDVVYYKADPNMYGEIKVGAD

SEQ ID NO: 216 - protein, 453 aa, Glycine max
MATWVLSECSLKPLAPVIPRPRTGAVLSSTSKVGFLETNKVLEGSKFQPLRCNLRERNWGLKVSVPLRIASIEEEEQKSVDVINGSNGVEHEKLPEFDPGAPPPFNLADIRAAIPKHCWVKDPLKSMSYVVRDVIAVFGLASAAAYLNNWLVWPLYWAAQGTMFWALFVLGHDCGHGSFSNNPKLNSVVGHLLHSSILVPYHGWRISHRTHHQHHGHVENDESWHPLPEKLFRSLDTVTRMLRFTAPFPLLAYPVYLWGRSPGKTGSHFDPSSDLFVPNERKDVITSTACWAAMLGLLVGLGFVMGPIQLLKLYGVPYVIFVMWLDLVTYLHHHGHEDKLPWYRGKEWSYLRGGLTTLDRDYGLINNIHHDIGTHVIHHLFPQIPHYHLVEATEAAKPVFGKYYREPKKSSPLPFHLIGELIKSFKTDHFVSDKGDVVYYQTDSEINGSSKSE

SEQ ID NO: 217 - protein, 451 aa, Vernicia fordii
MAVWALSDCGIRPLPKIYSKPRLAFTSNNPQPTKPPIPRPELRNGSSFKLSSAGLRDKWVVNLSAPLRGGLVEEDEDNFEGNRVISIDESGGEDFDPDAPPPDTLADIRAAIPKHRWTKNPEISLSYVVRNVAVVSGLAAVAAYFNDWAFWSPYWICQGTMLSALFVLGHDCGHGSFSNNPNLDSVVGHLLHYSILVPYHGWRISYRTHYRHHQHAENDESWHPLSEKIYKGLNNVTRTLRLSLPFSLLAYPSYLWSRSPGKKGFHFHPSSDLFVPSEKKDVITSTVCWTAMLALLVGSSFVMGLVQLLKPYGIPYLIFVMWLDLVTYLHHHGHENKIPWYRGEEWSYLRGRLTTVGRDYGWFNKIHHDIGIHVIHHLFPQIPHYHLIEATEAAKPVLGKYYREPKKSGPLPFHLLGSLIRSMKEDHYVSDAGDVVYYQKEPKLSGARCLS

SEQ ID NO: 218 - protein, 506 aa, Ricinus communis
MSAVMLARATNVAANNNVTSRTGSHERPHTPAAAAHFNLSLCLLSPFKGSPLQLEGILLMKKADSVNAFDALDGDADFDPSDPPPFKIAEIRAAIPKHCWIKNPWRSLSYVLRDAFVVLALAAAALFLDSWCFWPLYWAAQGTMFWAIFVLGHDCGHGSFSDSTLLNNVVGHLLHSSILVPYHGWRISHRTHHQNHGNVDKDESWVPLPEKIYNSLDVSTRIMRFTVPLPLLAYPIYLWTRGPGKDGSHFSPYSDLFAPNERRAVLTSTVCWILMILLLLYSCFVFGSVQVLKLYGVPYIIFIMWLDFVTYLHHHGHEQKLPWYRGKEWSYLRGGLTTVDRDYGWINNIHHDIGTHVIHHLFPQIPHYHLVEATKAAKPVLGKYYREPRKSGPFPLHLFENLVKSISQDHYVSDIGDVVYYQTDPELYKKLAKTKDVLEDLESCDALGILKCKNCSAKSGSSYSALQFLELKGRAAGAEKGREWKILVFEILTLHHRIIAQMSFMG

SEQ ID NO: 219 - protein, 392 aa, Linum usitatissimum
MSPPNSMGMEAAHPTGNGNGVAVMNGASANKPDFDPSEAPPFKIADIRAAIPPHCWVKNPWRSLSYVLRDAVVILAFAAAALKLDLWAVWPLYWIAQGTMFWAVFVLGHDCGHGSFSDSWWLNNVVGHILHSAILVPYHGWRISHKTHHQNHGNVEKDESWVPLPEKVYKTLDTSTKFMRFTIPLPMFAYPIYLWTRSPGKKGSHFNPYSDLFAPQERKSVLISTISWISMVLILLYASFLFGFLTVFKVYTVPYLIFVAWLDMVTYLHHHGHEEKLPWYRGQEWSYLRGGLTTVDRDYGIINNIHHDIGTHVIHHLFPQIPHYHLVEATKAAKSVLGKYYREPKKSGPFPFHLFDNLVRSLGEDHYVSDAGDVVFYQSDPEIFKFSKSKSA

SEQ ID NO: 220 - protein, 315 aa, Prototheca moriformis
MFWALFVVGHDCGHQSFSTSKRLNDAVGLFVHSIIGVPYHGWRISHRTHHNNHGHVENDESWYPPTESGLKAMTDMGRQGRFHFPSMLFVYPFYLFWRSPGKTGSHFSPATDLFALWEAPLIRTSNACQLAWLGALAAGTWALGVLPMLNLYLAPYVISVAWLDLVTYLHHHGPSDPREEMPWYRGREWSYMRGGLTTIDRDYGLFNKVHHDIGTHVVHHLFPQIPHYNLCRATKAAKKVLGPYYREPERCPLGLLPVHLLAPLLRSLGQDHFVDDAGSVLFYRRAEGINPWIQKLLPWLGGARRGADAQRDAAQ

SEQ ID NO: 221 - protein, 452 aa, Prototheca moriformis
MSIQFALRAAYIKGTCQRLSGRGAALGLSRDWTPGWTLPRCWPASAAATAPPRARHQERAIHLTSGRRRHSALASDADERALPSNAPGLVMASQANYFRVRLLPEQEEGELESWSPNVRHTTLLCKPRAMLSKLQMRVMVGDRVIVTAIDPVNMTVHAPPFDPLPATRFLVAGEAADMDITVVLNKADLVPEEESAALAQEVASWGPVVLTSTLTGRGLQELERQLGSTTAVLAGPSGAGKSSIINALARAARERPSDASVSNVPEEQVVGEDGRALANPPPFTLADIRNAIPKDCFRKSAAKSLAYLGDLSITGMAVLAYKINSPWLWPLYWFAQGTMFWALFVVGHDCGHQSFSTSKRLNDALAWLGALAAGTWTWALGVLPMLNLYLAPYVWLLVTYLHHHGPSDPREEMPWYRGREWSYMRGGLTTIDRDYGLFNKVHHDIGTHVVHH

SEQ ID NO: 222 - DNA, 6756 bp, Artificial Sequence
  synthesized construct
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggtggtggccatggaccagcgctccaacgtgaacggcgactccggcgcccgcaaggaggagggcgggcgcgccatggactacaaggaccacgacggcgactacaaggaccacgacatcgactacaaggacgacgacgacaagttcgacccctccgcccagccccccttcaagatcggcgacatccgcgccgccatccccaagcactgctgggtgaagtcccccctgcgctccatgtcctacgtgacccgcgacatcttcgccgtggccgccctggccatggccgccgtgtacttcgactcctggttcctgtggcccctgtactgggtggcccagggcaccctgttctgggccatcttcgtgctgggccacgactgcggccacggctccttctccgacatccccctgctgaactccgtggtgggccacatcctgcactccttcatcctggtgccctaccacggctggcgcatctcccaccgcacccaccaccagaaccacggccacgtggagaacgacgagtcctgggtgcccctgcccgagaagctgtacaagaacctgccccactccacccgcatgctgcgctacaccgtgcccctgcccatgctggcctaccccatctacctgtggtaccgctcccccggcaaggagggctcccacttcaacccctactcctccctgttcgccccctccgagcgcaagctgatcgccacctccaccacctgctggtccatcatgctggccaccctggtgtacctgtccttcctggtggaccccgtgaccgtgctgaaggtgtacggcgtgccctacatcatcttcgtgatgtggctggacgccgtgacctacctgcaccaccacggccacgacgagaagctgccctggtaccgcggcaaggagtggtcctacctgcgcggcggcctgaccaccatcgaccgcgactacggcatcttcaacaacatccaccacgacatcggcacccacgtgatccaccacctgttcccccagatcccccactaccacctggtggacgccacccgcgccgccaagcacgtgctgggccgctactaccgcgagcccaagacctccggcgccatccccatccacctggtggagtccctggtggcctccatcaagaaggaccactacgtgtccgacaccggcgacatcgtgttctacgagaccgaccccgacctgtacgtgtacgcctccgacaagtccaagatcaactagatcgatcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 223 - DNA, 1437 bp, Artificial Sequence
  synthesized construct
actagtatggccaacctggtgctgtccgagtgcggcatccgccccctgccccgcatctacaccaccccccgctccaacttcgtgtccaacaacaacaagcccatcttcaagttccgccccctgacctcctacaagacctcctcccccctgttctgctcccgcgacggcttcggccgcaactggtccctgaacgtgtccgtgcccctggccaccaccacccccatcgtggacgagtcccccctggaggaggaggaggaggaggagaagcagcgcgggcgcgccatggactacaaggaccacgacggcgactacaaggaccacgacatcgactacaaggacgacgacgacaagttcgaccccggcgcccccccccccttcaacctggccgacatccgcgccgccatccccaagcactgctgggtgaagaacccctggaagtccatgtcctacgtgctgcgcgacgtggccatcgtgttcgccctggccgccggcgccgcctacctgaacaactggatcgtgtggcccctgtactggctggcccagggcaccatgttctgggccctgttcgtgctgggccacgactgcggccacggctccttctccaacaacccccgcctgaacaacgtggtgggccacctgctgcactcctccatcctggtgccctaccacggctggcgcatctcccaccgcacccaccaccagaaccacggccacgtggagaacgacgagtcctggcaccccatgtccgagaagatctaccagtccctggacaagcccacccgcttcttccgcttcaccctgcccctggtgatgctggcctaccccttctacctgtgggcccgctcccccggcaagaagggctcccactaccaccccgagtccgacctgttcctgcccaaggagaagaccgacgtgctgacctccaccgcctgctggaccgccatggccgccctgctgatctgcctgaacttcgtggtgggccccgtgcagatgctgaagctgtacggcatcccctactggatcaacgtgatgtggctggacttcgtgacctacctgcaccaccacggccacgaggacaagctgccctggtaccgcggcaaggagtggtcctacctgcgcggcggcctgaccaccctggaccgcgactacggcgtgatcaacaacatccaccacgacatcggcacccacgtgatccaccacctgttcccccagatcccccactaccacctggtggaggccaccgaggccgtgaagcccgtgctgggcaagtactaccgcgagcccgacaagtccggccccctgcccctgcacctgctgggcatcctggccaagtccatcaaggaggaccactacgtgtccgacgagggcgacgtggtgtactacaaggccgaccccaacatgtacggcgagatcaaggtgggcgccgactagatcgat

SEQ ID NO: 224 - DNA, 1269 bp, Artificial Sequence
  synthesized construct
actagtatgtccccccccaactccatgtcccccgccaccaacggctccaccaacggcgtggccatcaacggcgccaagaagctgctggacgggcgcgccatggactacaaggaccacgacggcgactacaaggaccacgacatcgactacaaggacgacgacgacaagttcgacccctccgccgccccccccttcaagatcgccgacatccgcgccgccatccccccccactgctgggtgaagaacccctggcgctccctgtcctacgtgctgcgcgacctgctggtgatcctgtccttcgccgtggccgccaccaagctggactcctggaccgtgtggcccctgtactggatcgcccagggcaccatgttctgggccgtgttcgtgctgggccacgactgcggccacggctccttctccgactcctggctgctgaacaacgtgatgggccacatcctgcactcctccatcctggtgccctaccacggctggcgcatctcccacaagacccaccaccagaaccacggcaacgtggagaaggacgagtcctgggtgcccctgcccgagaaggtgtacaagtccctggacaccggcaccaagttcatgcgcttcaccatccccctgcccatgttcgcctaccccatctacctgtggcgccgctcccccggcaagaagggctcccacttcaacccctactccgacctgttcgcccccaacgagcgcacctccgtgatgatctccaccctgtgctggaccgccatggccctgctgctgtgctactcctccttcatctacggcttcctgcccgtgttcaagatctacggcgtgccctacctgatcttcgtggcctggctggacatggtgacctacctgcaccaccacggctacgagcagaagctgccctggtaccgcggcaaggagtggtcctacctgcgcggcggcctgaccaccgtggaccgcgactacggcgtgatcaacaacatccaccacgacatcggcacccacgtgatccaccacctgttcccccagatgccccactaccacctggtggaggccacccaggccgccaagcacgtgctgggcaagtactaccgcgagcccaagaagtccggccccttccccttccacctgttcggctacctggtgcgctccctgggcgaggaccactacgtgtccgacaccggcgacgtggtgttctaccagtccgacccccacatccccaagttccccacctccgccaccaccaagtccaagtcctcctagatcgat

SEQ ID NO: 225 - DNA, 1266 bp, Artificial Sequence
  synthesized construct
actagtatgtccccccccaactccatgtcccccaccaccaacggcaacggcgtggccatgaacggcgccaagaagcagctggacgggcgcgccatggactacaaggaccacgacggcgactacaaggaccacgacatcgactacaaggacgacgacgacaagttcgacccctccgccgccccccccttcaagatcgccgacatccgcgccgccatccccccccactgctgggtgaagaacccctggcgctccctgtcctacgtgctgcgcgacctgctggtgatcctgtccttcgccgtggccgccgccaagctggactcctggaccttctggcccctgtactgggtggcccagggcaccatgttctgggccgtgttcgtgctgggccacgactgcggccacggctccttctccgacatctggctgctgaacaacgtgatgggccacatcctgcactcctccatcctggtgccctaccacggctggcgcatctcccacaagacccaccaccagaaccacggcaacgtggagaaggacgagtcctgggtgcccctgcccgagaaggtgtacaagtccctggacacctccaccaagttcatgcgcttcaccatccccctgcccatgttcgcctaccccatctacctgtggacccgctcccccggcaagaagggctcccacttcaacccctactccgacctgttcgcccccaacgagcgcgccgccgtgctgatctccaccctgtgctggaccgccatggccctgctgctgtgctactcctccttcatctacggcttcgcccccgtgctgaagatctacggcgtgccctacctgatcttcgtggcctggctggacatggtgacctacctgcaccaccacggctacgagcagaagctgccctggtaccgcggcaaggagtggtcctacctgcgcggcggcctgaccaccgtggaccgcgactacggcgtgatcaacaacatccaccacgacatcggcacccacgtgatccaccacctgttcccccagatgccccactaccacctggtggaggccacccaggccgccaagcacgtgctgggcaagtactaccgcgagcccaagaagtccggccccttccccttccacctgttcggctacctggtgcgctccctgggcgaggaccactacgtgtccgacaccggcgacgtggtgttctaccagtccgacccccacatccccaagttccgcacctcctccgccaccaccaagtccaagtcctcctagatcgat

SEQ ID NO: 226 - DNA, 5246 bp, Artificial Sequence
  synthesized construct
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggtgtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacactagtgggtcgccgcgctgcctcgcgtcccctggtggtgcacgccgtcgccagcgaggccccgctgggcgtgccgccctcggtgcagcgcccctcccccgtggtctactccaagctggacaagcaacaccgcctgacgcccgagcgcctggagctggtgcagagcatggggcagtttgcggaggagaggtgtgtttgagggttttggttgcccgtatcgaggtcctggtggcgcgcatgggggagaaggcgcctgtcccgctgacccccccggctaccctcccggcaccttccagggcgcgtacgggatccctctcctccacaaactgccccatgctctgcaccagctccaggcgctcgggcgtcaggcggtgctgcttgtccagcttggagtagaccacgggggaggggcgctgcaccgagggcggaacgcccagcggggcctcgctggcgaccgcgcgcaccaccaggggacgcgaggcagcgcggcgacccaagcttgcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctggagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 227 - DNA, 615 bp, Artificial Sequence
  synthesized construct
actagttgcccgtgctgcaccccgtggacaagctgtggcagccgcaggacttcctgcccgaccccgagtcgcccgacttcgaggaccaggtggcggagctgcgcgcgcgcgccaaggacctgcccgacgagtactttgtggtgctggtgggcgacatgatcacggaggaggcgctgccgacctacatggccatgctcaacaccttggacggtgtgcgcgacgacacgggcgcggccgaccacccgtgtgtgtttgagggttttggttgcccgtattgaggtcctggtggcgcgcatggaggagaaggcgcctgtcccgctgacccccccggctaccctcccggcaccttccagggcgcgtacgggatccacgggtggtcggccgcgcccgtgtcgtcgcgcacaccgtccaaggtgttgagcatggccatgtaggtcggcagcgcctcctccgtgatcatgtcgcccaccagcaccacaaagtactcgtcgggcaggtccttggcgcgcgcgcgcagctccgccacctggtcctcgaagtcgggcgactcggggtcgggcaggaagtcctgcggctgccacagcttgtccacggggtgcagcacgggcaaagctt

SEQ ID NO: 228 - DNA, 615 bp, Artificial Sequence
  synthesized construct
actagtgcgctggacgcggcagtgggtggccgaggagaaccggcacggcgacctgctgaacaagtactgttggctgacggggcgcgtcaacatgcgggccgtggaggtgaccatcaacaacctgatcaagagcggcatgaacccgcagacggacaacaacccttacttgggcttcgtctacacctccttccaggagcgcgcgaccaagtacagccacggcaacaccgcgcgccttgcggccgagcagtgtgtttgagggttttggttgcccgtatcgaggtcctggtggcgcgcatgggggagaaggcgcctgtcccgctgacccccccggctaccctcccggcaccttccagggcgcgtacgggatcctgctcggccgcaaggcgcgcggtgttgccgtggctgtacttggtcgcgcgctcctggaaggaggtgtagacgaagcccaagtaagggttgttgtccgtctgcgggttcatgccgctcttgatcaggttgttgatggtcacctccacggcccgcatgttgacgcgccccgtcagccaacagtacttgttcagcaggtcgccgtgccggttctcctcggccacccactgccgcgtccagcgcaagctt

SEQ ID NO: 229 - DNA, 613 bp, Artificial Sequence
  synthesized construct
actagtgctgatcgccagcgacgagggccggcacgagatcgcctacacgcgcatcgtggacgagttcttccgcctcgaccccgagggcgccgtcgccgcctacgccaacatgatgcgcaagcagatcaccatgcccgcgcacctcatggacgacatgggccacggcgaggccaacccgggccgcaacctcttcgccgacttctccgcggtcgccgagaagatcgacgtctacgacgccgaggactgtgtgtttgagggttttggttgcccgtatcgaggtcctggtggcgcgcatgggggagaaggcgcctgtcccgctgacccccccggctaccctcccggcaccttccagggcgcgtacgggatccagtcctcggcgtcgtagacgtcgatcttctcggcgaccgcggagaagtcggcgaagaggttgcggcccgggttggcctcgccgtggcccatgtcgtccatgaggtgcgcgggcatggtgatctgcttgcgcatcatgttggcgtaggcggcgacggcgccctcggggtcgaggcggaagaactcgtccacgatgcgcgtgtaggcgatctcgtgccggccctcgtcgctggcgatcagcaagctt

SEQ ID NO: 230 - DNA, 1503 bp, Artificial Sequence
  synthesized construct
atggccaccgcatccactttctcggcgttcaatgcccgctgcggcgacctgcgtcgctcggcgggctccgggccccggcgcccagcgaggcccctccccgtgcgcgggcgcgcctccacccactccggcaagaccatggccgtggccctgcagcccacccaggagatcaccaccatcaagaagccccccaccaagcagcgccgcgtggtggtgaccggcctgggcgtggtgacccccctgggccacgagcccgacatcttctacaacaacctgctggacggcgcctccggcatctccgagatcgagaccttcgactgcgccgagtaccccacccgcatcgccggcgagatcaagtccttctccaccgacggctgggtggcccccaagctgtccaagcgcatggacaagttcatgctgtacatgctgaccgccggcaagaaggccctggtggacggcggcatcaccgacgacgtgatggacgagctgaacaaggagaagtgcggcgtgctgatcggctccgccatgggcggcatgaaggtgttcaacgacgccatcgaggccctgcgcatctcctacaagaagatgaaccccttctgcgtgcccttcgccaccaccaacatgggctccgccatgctggccatggacctgggctggatgggccccaactactccatctccaccgcctgcgccacctccaacttctgcatcctgaacgccgccaaccacatcatccgcggcgaggccgacgtgatgctgtgcggcggctccgacgccgccatcatccccatcggcctgggcggcttcgtggcctgccgcgccctgtcccagcgcaacaccgaccccaccaaggcctcccgcccctgggacatcaaccgcgacggcttcgtgatgggcgagggcgccggcgtgctgctgctggaggagctggagcacgccaaggagcgcggcgccaccatctacgccgagttcctgggcggctccttcacctgcgacgcctaccacgtgaccgagccccgccccgacggcgccggcgtgatcctgtgcatcgagaaggccctggcccagtccggcgtgtccaaggaggacgtgaactacatcaacgcccacgccacctccacccccgccggcgacctgaaggagtaccaggccctgatgcactgcttcggccagaaccccgagctgcgcgtgaactccaccaagtccatgatcggccacctgctgggcgccgccggcggcgtggaggccgtggccaccatccaggccatccgcaccggctgggtgcaccccaacatcaacctggagaaccccgacaacggcgtggacgccaaggtgctggtgggctccaagaaggagcgcctggacgtgaaggccgccctgtccaactccttcggcttcggcggccacaactcctccatcatcttcgccccctacatggactacaaggaccacgacggcgactacaaggaccacgacatcgactacaaggacgacgacgacaagtga

SEQ ID NO: 231 - DNA, 1530 bp, Artificial Sequence
  synthesized construct
atggccaccgcatccactttctcggcgttcaatgcccgctgcggcgacctgcgtcgctcggcgggctccgggccccggcgcccagcgaggcccctccccgtgcgcgggcgcgcctgccgccgcggcggccgcgtggccatggccatcgccatccagccctcctccatcgagatggaggaggagaccaccctgaccaagcgcaagcagccccccaccaagcagcgccgcgtggtggtgaccggcatgggcgtggagacccccatcggcaacaaccccgaccagttctacaacaacctgctgcagggcgtgtccggcatcacccagatcgaggccttcgactgctcctcctaccccacccgcatcgccggcgagatcaagaacttctccaccgacggctgggtggcccccaagctgtccaagcgcatggaccgcttcatgctgtacatgctgaccgccggcaagaaggccctggccgacgccggcatctccccctccgactccgacgagatcgacaagtcccgctgcggcgtgctgatcggctccgccatgggcggcatgaaggtgttcaacgacgccatcgaggccctgcgcgtgtcctaccgcaagatgaaccccttctgcgtgcccttcgccaccaccaacatgggctccgccatgctggccatggacctgggctggatgggccccaactactccatctccaccgcctgcgccacctccaacttctgcatcctgaacgccgccaaccacatcatccgcggcgaggccgacatgatgctgtgcggcggctccgacgccgtgatcatccccatcggcctgggcggcttcgtggcctgccgcgccctgtccgagcgcaacaccgaccccgccaaggcctcccgcccctgggactccggccgcgacggcttcgtgatgggcgagggcgccggcgtgctgctgctggaggagctggagcacgccaagaagcgcggcgccaagatctacgccgagttcctgggcggctccttcacctgcgacgcctaccacatgaccgagccccaccccgagggcgccggcgtgatcctgtgcatcgagaaggccctgtcccaggccggcgtgcgccgcgaggacgtgaactacatcaacgcccacgccacctccacccccgccggcgacctgaaggagtaccacgccctgctgcactgcttcggcaacaaccaggagctgcgcgtgaactccaccaagtccatgatcggccacctgctgggcgccgccggcgccgtggaggccgtggccaccgtgcaggccatccgcaccggctggatccaccccaacatcaacctggagaaccccgaccagggcgtggacaccaaggtgctggtgggctccaagaaggagcgcctgaacgtgaaggtgggcctgtccaactccttcggcttcggcggccacaactcctccatcctgttcgcccccttccagatggactacaaggaccacgacggcgactacaaggaccacgacatcgactacaaggacgacgacgacaagtga

SEQ ID NO: 232 - DNA, 1584 bp, Artificial Sequence
  synthesized construct
atggccaccgcatccactttctcggcgttcaatgcccgctgcggcgacctgcgtcgctcggcgggctccgggccccggcgcccagcgaggcccctccccgtgcgcgggcgcgcctcccactactactcctccaacggcctgttccccaacacccccctgctgcccaagcgccacccccgcctgcaccaccgcctgccccgctccggcgaggccatggccgtggccgtgcagcccgagaaggaggtggccaccaacaagaagcccctgatgaagcagcgccgcgtggtggtgaccggcatgggcgtggtgtcccccctgggccacgacatcgacgtgtactacaacaacctgctggacggctcctccggcatctcccagatcgactccttcgactgcgcccagttccccacccgcatcgccggcgagatcaagtccttctccaccgacggctgggtggcccccaagctgtccaagcgcatggacaagttcatgctgtacatgctgaccgccggcaagaaggccctggccgacggcggcatcaccgaggacatgatggacgagctggacaaggcccgctgcggcgtgctgatcggctccgccatgggcggcatgaaggtgttcaacgacgccatcgaggccctgcgcatctcctaccgcaagatgaaccccttctgcgtgcccttcgccaccaccaacatgggctccgccatgctggccatggacctgggctggatgggccccaactactccatctccaccgcctgcgccacctccaacttctgcatcctgaacgccgccaaccacatcatccgcggcgaggccgacatcatgctgtgcggcggctccgacgccgccatcatccccatcggcctgggcggcttcgtggcctgccgcgccctgtcccagcgcaacgacgaccccaccaaggcctcccgcccctgggacatgaaccgcgacggcttcgtgatgggcgagggcgccggcgtgctgctgctggaggagctggagcacgccaagaagcgcggcgccaacatctacgccgagttcctgggcggctccttcacctgcgacgcctaccacatgaccgagccccgccccgacggcgtgggcgtgatcctgtgcatcgagaaggccctggcccgctccggcgtgtccaaggaggaggtgaactacatcaacgcccacgccacctccacccccgccggcgacctgaaggagtacgaggccctgatgcgctgcttctcccagaaccccgacctgcgcgtgaactccaccaagtccatgatcggccacctgctgggcgccgccggcgccgtggaggccatcgccaccatccaggccatccgcaccggctgggtgcaccccaacatcaacctggagaaccccgaggagggcgtggacaccaaggtgctggtgggccccaagaaggagcgcctggacatcaaggtggccctgtccaactccttcggcttcggcggccacaactcctccatcatcttcgccccctacaagatggactacaaggaccacgacggcgactacaaggaccacgacatcgactacaaggacgacgacgacaagtga

SEQ ID NO: 233 - DNA, 7008 bp, Artificial Sequence
  synthesized construct
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggccaccgcatccactttctcggcgttcaatgcccgctgcggcgacctgcgtcgctcggcgggctccgggccccggcgcccagcgaggcccctccccgtgcgcgggcgcgccgccgccgccgccgacgccaaccccgcccgccccgagcgccgcgtggtgatcaccggccagggcgtggtgacctccctgggccagaccatcgagcagttctactcctccctgctggagggcgtgtccggcatctcccagatccagaagttcgacaccaccggctacaccaccaccatcgccggcgagatcaagtccctgcagctggacccctacgtgcccaagcgctgggccaagcgcgtggacgacgtgatcaagtacgtgtacatcgccggcaagcaggccctggagtccgccggcctgcccatcgaggccgccggcctggccggcgccggcctggaccccgccctgtgcggcgtgctgatcggcaccgccatggccggcatgacctccttcgccgccggcgtggaggccctgacccgcggcggcgtgcgcaagatgaaccccttctgcatccccttctccatctccaacatgggcggcgccatgctggccatggacatcggcttcatgggccccaactactccatctccaccgcctgcgccaccggcaactactgcatcctgggcgccgccgaccacatccgccgcggcgacgccaacgtgatgctggccggcggcgccgacgccgccatcatcccctccggcatcggcggcttcatcgcctgcaaggccctgtccaagcgcaacgacgagcccgagcgcgcctcccgcccctgggacgccgaccgcgacggcttcgtgatgggcgagggcgccggcgtgctggtgctggaggagctggagcacgccaagcgccgcggcgccaccatcctggccgagctggtgggcggcgccgccacctccgacgcccaccacatgaccgagcccgacccccagggccgcggcgtgcgcctgtgcctggagcgcgccctggagcgcgcccgcctggcccccgagcgcgtgggctacgtgaacgcccacggcacctccacccccgccggcgacgtggccgagtaccgcgccatccgcgccgtgatcccccaggactccctgcgcatcaactccaccaagtccatgatcggccacctgctgggcggcgccggcgccgtggaggccgtggccgccatccaggccctgcgcaccggctggctgcaccccaacctgaacctggagaaccccgcccccggcgtggaccccgtggtgctggtgggcccccgcaaggagcgcgccgaggacctggacgtggtgctgtccaactccttcggcttcggcggccacaactcctgcgtgatcttccgcaagtacgacgagatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 234 - DNA, 7008 bp, Artificial Sequence; identical to SEQ ID NO: 233
  synthesized construct

SEQ ID NO: 235 - DNA, 1476 bp, Artificial Sequence
  synthesized construct
atggccaccgcatccactttctcggcgttcaatgcccgctgcggcgacctgcgtcgctcggcgggctccgggccccggcgcccagcgaggcccctccccgtgcgcgggcgcgccgccgccgccgccgacgccaaccccgcccgccccgagcgccgcgtggtgatcaccggccagggcgtggtgacctccctgggccagaccatcgagcagttctactcctccctgctggagggcgtgtccggcatctcccagatccagaagttcgacaccaccggctacaccaccaccatcgccggcgagatcaagtccctgcagctggacccctacgtgcccaagcgctgggccaagcgcgtggacgacgtgatcaagtacgtgtacatcgccggcaagcaggccctggagtccgccggcctgcccatcgaggccgccggcctggccggcgccggcctggaccccgccctgtgcggcgtgctgatcggcaccgccatggccggcatgacctccttcgccgccggcgtggaggccctgacccgcggcggcgtgcgcaagatgaaccccttctgcatccccttctccatctccaacatgggcggcgccatgctggccatggacatcggcttcatgggccccaactactccatctccaccgcctgcgccaccggcaactactgcatcctgggcgccgccgaccacatccgccgcggcgacgccaacgtgatgctggccggcggcgccgacgccgccatcatcccctccggcatcggcggcttcatcgcctgcaaggccctgtccaagcgcaacgacgagcccgagcgcgcctcccgcccctgggacgccgaccgcgacggcttcgtgatgggcgagggcgccggcgtgctggtgctggaggagctggagcacgccaagcgccgcggcgccaccatcctggccgagctggtgggcggcgccgccacctccgacgcccaccacatgaccgagcccgacccccagggccgcggcgtgcgcctgtgcctggagcgcgccctggagcgcgcccgcctggcccccgagcgcgtgggctacgtgaacgcccacggcacctccacccccgccggcgacgtggccgagtaccgcgccatccgcgccgtgatcccccaggactccctgcgcatcaactccaccaagtccatgatcggccacctgctgggcggcgccggcgccgtggaggccgtggccgccatccaggccctgcgcaccggctggctgcaccccaacctgaacctggagaaccccgcccccggcgtggaccccgtggtgctggtgggcccccgcaaggagcgcgccgaggacctggacgtggtgctgtccaactccttcggcttcggcggccacaactcctgcgtgatcttccgcaagtacgacgagatggactacaaggaccacgacggcgactacaaggaccacgacatcgactacaaggacgacgacgacaagtga

SEQ ID NO: 236 - protein, 491 aa, Artificial Sequence
  synthesized construct
MATASTFSAFNARCGDLRRSAGSGPRRPARPLPVRGRAAAAADANPARPERRVVITGQGVVTSLGQTIEQFYSSLLEGVSGISQIQKFDTTGYTTTIAGEIKSLQLDPYVPKRWAKRVDDVIKYVYIAGKQALESAGLPIEAAGLAGAGLDPALCGVLIGTAMAGMTSFAAGVEALTRGGVRKMNPFCIPFSISNMGGAMLAMDIGFMGPNYSISTACATGNYCILGAADHIRRGDANVMLAGGADAAIIPSGIGGFIACKALSKRNDEPERASRPWDADRDGFVMGEGAGVLVLEELEHAKRRGATILAELVGGAATSDAHHMTEPDPQGRGVRLCLERALERARLAPERVGYVNAHGTSTPAGDVAEYRAIRAVIPQDSLRINSTKSMIGHLLGGAGAVEAVAAIQALRTGWLHPNLNLENPAPGVDPVVLVGPRKERAEDLDVVLSNSFGFGGHNSCVIFRKYDEMDYKDHDGDYKDHDIDYKDDDDK

SEQ ID NO: 237 - DNA, 3602 bp, Artificial Sequence
  synthesized construct
gctcttcgctcaccgcgtgaattgctgtcccaaacgtaagcatcatcgtggctcggtcacgcgatcctggatccggggatcctagaccgctggtggagagcgctgccgtcggattggtggcaagtaagattgcgcaggttggcgaagggagagaccaaaaccggaggctggaagcgggcacaacatcgtattattgcgtatagtagagcagtggcagtcgcatttcgaggtccgcaacggatctcgcaagctcgctacgctcacagtaggagaaaggggaccactgcccctgccagaatggtcgcgaccctctccctcgccggccccgcctgcaacacgcagtgcgtatccggcaagcgggctgtcgccttcaaccgcccccatgttggcgtccgggctcgatcaggtgcgctgaggggggtttggtgtgcccgcgcctctgggcccgtgtcggccgtgcggacgtggggccctgggcagtggatcagcagggtttgcgtgcaaatgcctataccggcgattgaatagcgatgaacgggatacggttgcgctcactccatgcccatgcgaccccgtttctgtccgccagccgtggtcgcccgggctgcgaagcgggaccccacccagcgcattgtgatcaccggaatgggcgtggggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcgtagagctccacctgcatccgcctggcgctcgaggacgccggcgtctcgcccgacgaggtcaactacgtcaacgcgcacgccacctccaccctggtgggcgacaaggccgaggtgcgcgcggtcaagtcggtctttggcgacatgaagggcatcaagatgaacgccaccaagtccatgatcgggcactgcctgggcgccgccggcggcatggaggccgtcgccacgctcatggccatccgcaccggctgggtgcaccccaccatcaaccacgacaaccccatcgccgaggtcgacggcctggacgtcgtcgccaacgccaaggcccagcacaaaatcaacgtcgccatctccaactccttcggcttcggcgggcacaactccgtcgtcgcctttgcgcccttccgcgagtaggcggagcgagcgcgcttggctgaggagggaggcggggtgcgagccctttggctgcgcgcgatactctccccgcacgagcagactccacgcgcctgaatctacttgtcaacgagcaaccgtgtgttttgtccgtggccattcttattatttctccgactgtggccgtactctgtttggctgtgcaagcaccgaagagc

SEQ ID NO: 238 - DNA, 661 bp, Artificial Sequence
  synthesized construct
gctcttcgctcaccgcgtgaattgctgtcccaaacgtaagcatcatcgtggctcggtcacgcgatcctggatccggggatcctagaccgctggtggagagcgctgccgtcggattggtggcaagtaagattgcgcaggttggcgaagggagagaccaaaaccggaggctggaagcgggcacaacatcgtattattgcgtatagtagagcagtggcagtcgcatttcgaggtccgcaacggatctcgcaagctcgctacgctcacagtaggagaaaggggaccactgcccctgccagaatggtcgcgaccctctccctcgccggccccgcctgcaacacgcagtgcgtatccggcaagcgggctgtcgccttcaaccgcccccatgttggcgtccgggctcgatcaggtgcgctgaggggggtttggtgtgcccgcgcctctgggcccgtgtcggccgtgcggacgtggggccctgggcagtggatcagcagggtttgcgtgcaaatgcctataccggcgattgaatagcgatgaacgggatacggttgcgctcactccatgcccatgcgaccccgtttctgtccgccagccgtggtcgcccgggctgcgaagcgggaccccacccagcgcattgtgatcaccggaatgggcgtggggtacc

SEQ ID NO: 239 - DNA, 605 bp, Artificial Sequence
  synthesized construct
gagctccacctgcatccgcctggcgctcgaggacgccggcgtctcgcccgacgaggtcaactacgtcaacgcgcacgccacctccaccctggtgggcgacaaggccgaggtgcgcgcggtcaagtcggtctttggcgacatgaagggcatcaagatgaacgccaccaagtccatgatcgggcactgcctgggcgccgccggcggcatggaggccgtcgccacgctcatggccatccgcaccggctgggtgcaccccaccatcaaccacgacaaccccatcgccgaggtcgacggcctggacgtcgtcgccaacgccaaggcccagcacaaaatcaacgtcgccatctccaactccttcggcttcggcgggcacaactccgtcgtcgcctttgcgcccttccgcgagtaggcggagcgagcgcgcttggctgaggagggaggcggggtgcgagccctttggctgcgcgcgatactctccccgcacgagcagactccacgcgcctgaatctacttgtcaacgagcaaccgtgtgttttgtccgtggccattcttattatttctccgactgtggccgtactctgtttggctgtgcaagcaccgaagag

SEQ ID NO: 240 - DNA, 3124 bp, Artificial Sequence
  synthesized construct
gctcttcgctggcctgttgccggacgatccgtgtcgtcgagactgcattttgttttgggtgtggggctggggtactggatggcttgagggcatgactttttctgatggagaagattgcaatgagatcatttgggtcgtctatttgtttgctgtgcaagagggtttactggtatctggcaccagcttttggcccgtgcccgtttgatggacgcgtgacaggcaggcgtcctggaaagcacagacaccgtacgtacgaccttgacctcccccccttctccacacggcaggtgcgaggctgcccacggcgtcgaggcgggcggtgcgccgggcatggtcccgcatcgcgcgcgcggcggccgcggccgacgcaaaccccgcccgccctgagcgccgcgtggtcatcacgggccagggcgtggtgaccagcctgggccagacgatcgagcagttttacagcagcctgctggagggcgtgagcggcatctcgcagatacagaagttcgacaccacgggctacacgacgacgatcgcgggcgagatcaagtcgctgcagctggacccgtacgtgcccaagcgctgggcgaagcgcgtggacgacgtgataaagtacgtctacatcgcgggcaagcaggcgctggagagcgccggcctgccgatcgaggcggcggggctggcgggcgcggggctggacccggcgctgtgcggcgtgctcatcggcaccgccatggcgggcatgacgtctttcgcggcgggcgtggaggcgctgacgcgcggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgatcgagcaggacggcctccacgccggctcccccgccgcctgggtggagcgcctgttcggctacgactgggcccagcagaccatcggctgctccgacgccgccgtgttccgcctgtccgcccagggccgccccgtgctgttcgtgaagaccgacctgtccggcgccctgaacgagctgcaggacgaggccgcccgcctgtcctggctggccaccaccggcgtgccctgcgccgccgtgctggacgtggtgaccgaggccggccgcgactggctgctgctgggcgaggtgcccggccaggacctgctgtcctcccacctggcccccgccgagaaggtgtccatcatggccgacgccatgcgccgcctgcacaccctggaccccgccacctgccccttcgaccaccaggccaagcaccgcatcgagcgcgcccgcacccgcatggaggccggcctggtggaccaggacgacctggacgaggagcaccagggcctggcccccgccgagctgttcgcccgcctgaaggcccgcatgcccgacggcgaggacctggtggtgacccacggcgacgcctgcctgcccaacatcatggtggagaacggccgcttctccggcttcatcgactgcggccgcctgggcgtggccgaccgctaccaggacatcgccctggccacccgcgacatcgccgaggagctgggcggcgagtgggccgaccgcttcctggtgctgtacggcatcgccgcccccgactcccagcgcatcgccttctaccgcctgctggacgagttcttctgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatccactagttctagagcggccgccaccgcggtggagctcggcggcgtgcgcaagatgaaccccttttgcatccccttctccatctccaacatgggcggcgcgatgctggcgatggacatcggcttcatgggccccaactactccatctccacggcctgcgcgacgggcaactactgcatcctgggcgcggcggaccacatccggcgcggcgacgcaaacgtgatgctggccggcggcgcggacgcggccatcatcccctcgggcatcggcggcttcatcgcgtgcaaggcgctgagcaagcgcaacgacgagcccgagcgcgcgagccggccctgggacgccgaccgcgacggcttcgtcatgggcgagggcgccggcgtgctggtgctggaggagctggagcacgccaagcgccgcggcgcgaccattttggctgaattagttggcggcgcggccacctcggacgcgcaccacatgaccgagcccgacccgcagggccgcggcgtgcgcctctgcctcgagcgcgcgctcgagcgcgcgcgcctcgcgcccgagcgcgtcggctacgtcaacgcgcacggcaccagcacgcccgcgggcgacgtggccgagtaccgcgccatccgcgccgtcatcccgcaggactcactacgcatcaactccacaaagtccatgatcgggcacctgctcggcggcgccggcgcggtcgaggccgtggccgccatccaggccctgcgcaccggctggctccaccccaacttgaacctcgagaaccccgcgcctggcgtcgaccccgtcgtgctcgtgggctcttcc

SEQ ID NO: 241 - DNA, 1173 bp, Artificial Sequence
  synthesized construct
actagtatgggcgccggcggccgcatgtccaacccctccgagggcgagaagaagaccgagctggagggcatccagcgcgtgccctaccagaagccccccttcaccgtgggcgacgggcgcgccgtgaagaaggccatccccccccactgcttcaaccgctccgtgatccgctccttctcctacgtggtgtacgacctgaccatcgcctccatcctgtactacatcgccaccaccttcatccccctgctgccccaccccctggcctacgtggcctggcccatctactgggccgtgcagggctgcgtgatgaccggcgtgtgggtgatcgcccacgagtgcggccaccacgccttctccgactaccagtggctggacgacaccgtgggcctgatcctgcactccgtgctgctggtgccctacttctcctggaagtactcccaccgccgccaccactccaacaccggctccatcgagcacgacgaggtgttcgtgcccaagctgaagtccggcgtgcgctccaccgccaagtacctgaacaacccccccggccgcatcctgaccctgctggtgaccctgaccctgggctggcccctgtacctgatgttcaacgtgtccggccgctactacgaccgcttcgcctgccacttcgaccccaactcccccatctactccaaccgcgagcgcgcccagatcttcatctccgacgccggcatcttcgccgtgctgtacggcctgtaccgcctggccgccgtgaagggcctggtgtgggtgctgaccgtgtacgccggccccctgctggtggtgaacggcttcctggtgctgatcaccttcctgcagcacacccacccctccctgccccactacgactccaccgagtgggactggctgcgcggcgccctggccaccatcgaccgcgactacggcatcctgaacaaggtgttccacaacatcaccgacacccacgtgacccaccacctgttctccaccatgccccactaccacgccatggaggccaccaaggccatcatccccatcctgggcgactactaccagttcgacggcacctccgtgttcaaggccatgtaccgcgagaccaaggagtgcatctacgtggacaaggacgaggaggtgaaggacggcgtgtactggtaccgcaacaagatctagatcgat

SEQ ID NO: 242 - DNA, 1173 bp, Artificial Sequence
  synthesized construct
actagtatgggcgccggcggccgcaccgacgtgccccccgccaaccgcaagtccgaggtggaccccctgaagcgcgtgcccttcgagaagccccccttctccctgtcccaggggcgcgccatcaagaaggtgatccccccccactgcttccagcgctccgtgttccgctccttctcctacgtggtgtacgacctgaccatcgccttctgcctgtactacgtggccacccactacttccacctgctgccctcccccctgtccttcctggcctggcccatctactgggccgtgcagggctgcatcctgaccggcgtgtgggtgatcgcccacgagtgcggccaccacgccttctccgactaccagctgctggacgacatcgtgggcctggtgctgcactccggcctgctggtgccctacttctcctggaagtactcccaccgccgccaccactccaacaccggctccctggagcgcgacgaggtgttcgtgcccaagcagaagtcctgcatcaagtggtactccaagtacctgaacaacccccccggccgcgtgctgaccctggccgtgaccctgaccctgggctggcccctgtacctggccctgaacgtgtccggccgcccctacgaccgcttcgcctgccactacgacccctacggccccatctactccgaccgcgagcgcctgcagatctacatctccgacgccggcgtgctggccgtgtgctacggcctgttccgcctggccatggccaagggcctggcctgggtggtgtgcgtgtacggcgtgcccctgctggtggtgaacggcttcctggtgctgatcaccttcctgcagcacacccaccccgccctgccccactacacctcctccgagtgggactggctgcgcggcgccctggccaccgtggaccgcgactacggcatcctggacaaggtgttccacaacatcaccgacacccacgtggcccacgagctgttctccaccatgccccactaccacgccatggaggccaccaaggccatcaagcccatcctgggcgagtactaccgcttcgacgagacccccttcgtgaaggccatgtggcgcgaggcccgcgagtgcatctacgtggagcccgaccagtccaccgagtccaagggcgtgttctggtacaacaacaagctgtagatcgat

SEQ ID NO: 243 - DNA, 1170 bp, Artificial Sequence
  synthesized construct
actagtatgggcgccggcggccgcatgtcctcccccaacggcaaggagaaggacggccccaagcccctggagcgcgccctgcacgagaagccccccttcaccgtgggcgacgggcgcgccatcaagaaggtgatccccccccactgcttcaagcgctccgtgatccgctccttctcctacgtggtgtacgacctgaccatcgcctccatcttctactacctggccaacaactacatccccctgctgcccaactccctggcctacgtggcctggcccgtgtactggatcttccagggctgcgtgctgaccggcgtgtgggtgatcgcccacgagtgcggccaccacgccttctccgactaccagtggctggacgacaccgtgggcctgatcctgcactccgccctgctggtgccctacttctcctggaagtactcccaccgccgccaccactccaacaccggctccatcgagcacgacgaggtgttcgtgcccaagctgaagtcctccgtgcgctccaccgccaagtacctgaacaacccccccggccgcatcctgaccctgctggtgaccctgaccatgggctggcccctgtacctgatgttcaacgtgtccggccgctactacgaccgcttcgcctgccacttcgaccccaactcccccatctactccaaccgcgagcgcgcccagatcttcatctccgacgccggcatcctgaccgtgttctacatcctgttccgcctggcctccaccaagggcctggtgtgggtgctgaccatgtacggcggccccctgctggtggtgaacggcttcctggtgctgatcaccttcctgcagcacacccacccctccctgccccactacgactccaccgagtgggactggctgcgcggcgccctggccaccgtggaccgcgactacggcatcctgaacaaggtgttccacaacatcaccgacacccacgtgacccaccacctgttctccaccatgccccactaccacgccatggaggccaccaaggccatcaagcccatcctgggcgactactaccagttcgacggcacctccatcttcaaggccatgtaccgcgagaccaaggagtgcatctacgtggacaaggacgaggacgtgaaggacggcgtgtactggtaccgcaacaagatctagatcgat

SEQ ID NO: 244 - DNA, 1185 bp, Artificial Sequence
  synthesized construct
actagtatgggcgccggcggccgcatgaccgagaaggagcgcgagaagcaggagcagctggcccgcgccaccggcggcgccgccatgcagcgctcccccgtggagaagccccccttcaccctgggccaggggcgcgccatcaagaaggccatccccccccactgcttcgagcgctccgtgctgaagtccttctcctacgtggtgcacgacctggtgatcgccgccgccctgctgtacttcgccctggccatcatccccgccctgccctcccccctgggctacgccgcctggcccctgtactggatcgcccagggctgcgtgtgcaccggcgtgtgggtgatcgcccacgagtgcggccaccacgccttctccgactactccctgctggacgacgtggtgggcctggtgctgcactcctccctgatggtgccctacttctcctggaagtactcccaccgccgccaccactccaacaccggctccctggagcgcgacgaggtgttcgtgcccaagaagaaggaggccctgccctggtacaccccctacgtgtacaacaaccccgtgggccgcctggcccacatcgtggtgcagctgaccctgggctggcccctgtacctggccaccaacgcctccggccgcccctacccccgcttcgcctgccacttcgacccctacggccccatctacaacgaccgcgagcgcgcccagatcttcgtgtccgacgccggcgtggccgccgtggccttcggcctgtacaagctggccgccgccttcggcgtgtggtgggtggtgcgcgtgtacgccgtgcccctgctgatcgtgaacgcctggctggtgctgatcacctacctgcagcacacccacccctccctgccccactacgactcctccgagtgggactggctgcgcggcgccctggccaccatggaccgcgactacggcatcctgaaccgcgtgttccacaacatcaccgacacccacgtggcccaccacctgttctccaccatgccccactaccacgccatggaggccaccaaggccatccgccccatcctgggcgactactaccacttcgaccccacccccgtggccaaggccacctggcgcgaggccggcgagtgcatctacgtggagcccgaggaccgcaagggcgtgttctggtacaacaagaagttctagatcgat

SEQ ID NO: 245 - DNA, 6756 bp, Artificial Sequence
  synthesized construct
gctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatgggcgccggcggccgcatgtccgtgcccacctcccccaagaagcccgagttcaactccctgaagcgcgtgccctactccaagccccccttcaccctgtccgaggggcgcgccatggactacaaggaccacgacggcgactacaaggaccacgacatcgactacaaggacgacgacgacaagatcaagaaggccatccccccccactgcttccagcgctccgtgctgcgctccttctcctacctgctgtacgacttcatcctggcctccctgttctaccacgtggccaccaactacttccccaacctgccccaggccctgtccaacgtggcctggcccctgtactgggccatgcagggctgcatcctgaccggcgtgtgggtgatcgcccacgagtgcggccaccacgccttctccgactaccagtggctggacgacaccgtgggcctgatcctgcactcctccctgctggtgccctacttctcctggaagtactcccaccgccgccaccactccaacaccggctccctggagcgcgacgaggtgttcgtgcccaagaagaagtccggcctgcgctggtgggccaagcacttcaacaacccccccggccgcttcctgtccatcaccatccagctgaccctgggctggcccctgtacctggccttcaacgtggccggccgcccctacgaccgcttcgcctgccactacgacccctacggccccatcttctccgaccgcgagcgcctgcagatctacatctccgacgccggcgtgctggccgtggcctacgccctgtaccgcctggtgctggccaagggcgtgggctgggtgatctccgtgtacggcgtgcccctgctggtggtgaacgccttcctggtgatgatcacctacctgcagcacacccacccctccctgccccactacgactcctccgagtgggactggatgcgcggcgccctgtccaccgtggaccgcgactacggcatcctgaacaaggtgttccacaacatcaccgacacccacgtggcccaccacctgttctccaccatgccccactaccacgccatggtggccaccaaggccatcaagcccatcctgggcgagtactaccagttcgacggcatgcccgtgtacaaggccatctggcgcgaggccaaggagtgcctgtacgtggagcccgacgagggcgacaaggacaagggcgtgttctggttccgcaacaagctgtagatcgatcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagc

SEQ ID NO: 246 - DNA, 9416 bp, Artificial Sequence
  synthesized construct
cactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgatgcatgctcttcgggctggtctgaatccttcaggcgggtgttacccgagaaagaaagggtgccgatttcaaagcagacccatgtgccgggccctgtggcctgtgttggcgcctatgtagtcaccccccctcacccaattgtcgccagtttgcgcactccataaactcaaaacagcagcttctgagctgcgctgttcaagaacacctctggggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccaggtgtgtttgagggttttggttgcccgtattgaggtcctggtggcgcgcatggaggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggccaccgcatccactttctcggcgttcaatgcccgctgcggcgacctgcgtcgctcggcgggctccgggccccggcgcccagcgaggcccctccccgtgcgcgggcgcgccgaggtgcacgtgcaggtgacccactccctggcccccgagaagcgcgagatcttcaactccctgaacaactgggcccaggagaacatcctggtgctgctgaaggacgtggacaagtgctggcagccctccgacttcctgcccgactccgcctccgagggcttcgacgagcaggtgatggagctgcgcaagcgctgcaaggagatccccgacgactacttcatcgtgctggtgggcgacatgatcaccgaggaggccctgcccacctaccagaccatgctgaacaccctggacggcgtgcgcgacgagaccggcgcctccctgaccccctgggccatctggacccgcgcctggaccgccgaggagaaccgccacggcgacctgctgaacaagtacctgtacctgtccggccgcgtggacatgaagcagatcgagaagaccatccagtacctgatcggctccggcatggacccccgcaccgagaacaacccctacctgggcttcatctacacctccttccaggagcgcgccaccttcatctcccacggcaacaccgcccgcctggccaaggagcacggcgacctgaagctggcccagatctgcggcatcatcgccgccgacgagaagcgccacgagaccgcctacaccaagatcgtggagaagctgttcgagatcgaccccgacggcaccgtgctggccctggccgacatgatgcgcaagaaggtgtccatgcccgcccacctgatgtacgacggccaggacgacaacctgttcgagaacttctcctccgtggcccagcgcctgggcgtgtacaccgccaaggactacgccgacatcctggagttcctggtgggccgctgggacatcgagaagctgaccggcctgtccggcgagggccgcaaggcccaggactacgtgtgcaccctgcccccccgcatccgccgcctggaggagcgcgcccagtcccgcgtgaagaaggcctccgccacccccttctcctggatcttcggccgcgagatcaacctgatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcccgccaccactccaacacggggtgcctggacaaggacgaggtgtttgtgccgccgcaccgcgcagtggcgcacgagggcctggagtgggaggagtggctgcccatccgcatgggcaaggtgctggtcaccctgaccctgggctggccgctgtacctcatgttcaacgtcgcctcgcggccgtacccgcgcttcgccaaccactttgacccgtggtcgcccatcttcagcaagcgcgagcgcatcgaggtggtcatctccgacctggcgctggtggcggtgctcagcgggctcagcgtgctgggccgcaccatgggctgggcctggctggtcaagacctacgtggtgccctacctgatcgtgaacatgtggctcgtgctcatcacgctgctccagcacacgcacccggcgctgccgcactacttcgagaaggactgggactggctgcgcggcgccatggccaccgtggaccgctccatgggcccgcccttcatggacaacatcctgcaccacatctccgacacccacgtgctgcaccacctcttcagcaccatcccgcactaccacgccgaggaggcctccgccgccatcaggcccatcctgggcaagtactaccagtccgacagccgctgggtcggccgcgccctgtgggaggactggcgcgactgccgctacgtcgtcccggacgcgcccgaggacgactccgcgctctggttccacaagtgagtgagtgagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgc

SEQ ID NO: 247 - DNA, 719 bp, Artificial Sequence
  synthesized construct
gggctggtctgaatccttcaggcgggtgttacccgagaaagaaagggtgccgatttcaaagcagacccatgtgccgggccctgtggcctgtgttggcgcctatgtagtcaccccccctcacccaattgtcgccagtttgcgcactccataaactcaaaacagcagcttctgagctgcgctgttcaagaacacctctggggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccaggtgtgtttgagggttttggttgcccgtattgaggtcctggtggcgcgcatggaggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccg

SEQ ID NO: 248 - DNA, 732 bp, Artificial Sequence
  synthesized construct
ccgccaccactccaacacggggtgcctggacaaggacgaggtgtttgtgccgccgcaccgcgcagtggcgcacgagggcctggagtgggaggagtggctgcccatccgcatgggcaaggtgctggtcaccctgaccctgggctggccgctgtacctcatgttcaacgtcgcctcgcggccgtacccgcgcttcgccaaccactttgacccgtggtcgcccatcttcagcaagcgcgagcgcatcgaggtggtcatctccgacctggcgctggtggcggtgctcagcgggctcagcgtgctgggccgcaccatgggctgggcctggctggtcaagacctacgtggtgccctacctgatcgtgaacatgtggctcgtgctcatcacgctgctccagcacacgcacccggcgctgccgcactacttcgagaaggactgggactggctgcgcggcgccatggccaccgtggaccgctccatgggcccgcccttcatggacaacatcctgcaccacatctccgacacccacgtgctgcaccacctcttcagcaccatcccgcactaccacgccgaggaggcctccgccgccatcaggcccatcctgggcaagtactaccagtccgacagccgctgggtcggccgcgccctgtgggaggactggcgcgactgccgctacgtcgtcccggacgcgcccgaggacgactccgcgctctggttccacaagtgagtgagtga

SEQ ID NO: 249 - DNA, 12342 bp, Artificial Sequence
  synthesized construct
tagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttgaatatggctcatattcttcctttttcaatattattgaagcatttatcagggttattgtctcatgagcggatacatatttgaatgtatttagaaaaataaacaaataggggtcagtgttacaaccaattaaccaattctgaacattatcgcgagcccatttatacctgaatatggctcataacaccccttgtttgcctggcggcagtagcgcggtggtcccacctgaccccatgccgaactcagaagtgaaacgccgtagcgccgatggtagtgtggggactccccatgcgagagtagggaactgccaggcatcaaataaaacgaaaggctcagtcgaaagactgggcctttcgcccgggctaattagggggtgtcgcccttattcgactctatagtgaagttcctattctctagaaagtataggaacttctgaagtggggaagaatgcatggctcttccggcctgttgccggacgatccgtgtcgtcgagactgcattttgttttgggtgtggggctggggtactggatggcttgagggcatgactttttctgatggagaagattgcaatgagatcatttgggtcgtctatttgtttgctgtgcaagagggtttactggtatctggcaccagcttttggcccgtgcccgtttgatggacgcgtgacaggcaggcgtcctggaaagcacagacaccgtacgtacgaccttgacctcccccccttctccacacggcaggtgcgaggctgcccacggcgtcgaggcgggcggtgcgccgggcatggtcccgcatcgcgcgcgcggcggccgcggccgacgcaaaccccgcccgccctgagcgccgcgtggtcatcacgggccagggcgtggtgaccagcctgggccagacgatcgagcagttttacagcagcctgctggagggcgtgagcggcatctcgcagatacagaagttcgacaccacgggctacacgacgacgatcgcgggcgagatcaagtcgctgcagctggacccgtacgtgcccaagcgctgggcgaagcgcgtggacgacgtgataaagtacgtctacatcgcgggcaagcaggcgctggagagcgccggcctgccgatcgaggcggcggggctggcgggcgcggggctggacccggcgctgtgcggcgtgctcatcggcaccgccatggcgggcatgacgtctttcgcggcgggcgtggaggcgctgacgcgcggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcgtagagctggatcctctaaagcttggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggtggccaccgccgcctcctccgccttcttccccctgccctccgccgacacctcctcccgccccggcaagctgggcaacaagccctcctccctgtcccccctgaagcccaagtccacccccaacggcggcctgcaggtgaaggccaacgcctccgccccccccaagatcaacggctcccccgtgggcctgaagtccggcggcctgaaggggcgcgccacccaggaggacgcccactccgccccccccccccgcaccttcatcaaccagctgcccgactggtccatgctgctggccgccatcaccaccgtgttcctggccgccgagaagcagtggatgatgctggactggaagcccaagcgccccgacatgctggtggaccccttcggcctgggctccatcgtgcaggacggcctggtgttccgccagaacttctccatccgctcctacgagatcggcgccgaccgcaccgcctccatcgagaccgtgatgaaccacctgcaggagaccgccctgaaccacgtgaagatcgccggcctgtccaacgacggcttcggccgcacccccgagatgtacaagcgcgacctgatctgggtggtggccaagatgcaggtgatggtgaaccgctaccccacctggggcgacaccgtggaggtgaacacctgggtggccaagtccggcaagaacggcatgcgccgcgactggctgatctccgactgcaacaccggcgagatcctgacccgcgcctcctccgtgtgggtgatgatgaaccagaagacccgccgcctgtccaagatccccgacgaggtgcgcaacgagatcgagccccacttcgtggactccccccccgtgatcgaggacgacgaccgcaagctgcccaagctggacgagaagaccgccgactccatccgcaagggcctgaccccccgctggaacgacctggacgtgaaccagcacgtgaacaacgtgaagtacatcggctggatcctggagtccaccccccccgaggtgctggagacccaggagctgtgctccctgaccctggagtaccgccgcgagtgcggccgcgagtccgtgctggagtccctgaccgccatggacccctccggcggcggctacggctcccagttccagcacctgctgcgcctggaggacggcggcgagatcgtgaagggccgcaccgagtggcgccccaagaacggcgtgatcaacggcgtggtgcccaccggcgagtcctcccccggcgactactccatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctgtagaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggtggccaccgccgcctcctccgccttcttccccctgccctccgccgacacctcctcccgccccggcaagctgggcaacaagccctcctccctgtcccccctgaagcccaagtccacccccaacggcggcctgcaggtgaaggccaacgcctccgccccccccaagatcaacggctcccccgtgggcctgaagtccggcggcctgaaggggcgcgccacccaggaggacgcccactccgccccccccccccgcaccttcatcaaccagctgcccgactggtccatgctgctggccgccatcaccaccgtgttcctggccgccgagaagcagtggatgatgctggactggaagcccaagcgccccgacatgctggtggaccccttcggcctgggctccatcgtgcaggacggcctggtgttccgccagaacttctccatccgctcctacgagatcggcgccgaccgcaccgcctccatcgagaccgtgatgaaccacctgcaggagaccgccctgaaccacgtgaagatcgccggcctgtccaacgacggcttcggccgcacccccgagatgtacaagcgcgacctgatctgggtggtggccaagatgcaggtgatggtgaaccgctaccccacctggggcgacaccgtggaggtgaacacctgggtggccaagtccggcaagaacggcatgcgccgcgactggctgatctccgactgcaacaccggcgagatcctgacccgcgcctcctccgtgtgggtgatgatgaaccagaagacccgccgcctgtccaagatccccgacgaggtgcgcaacgagatcgagccccacttcgtggactccccccccgtgatcgaggacgacgaccgcaagctgcccaagctggacgagaagaccgccgactccatccgcaagggcctgaccccccgctggaacgacctggacgtgaaccagcacgtgaacaacgtgaagtacatcggctggatcctggagtccaccccccccgaggtgctggagacccaggagctgtgctccctgaccctggagtaccgccgcgagtgcggccgcgagtccgtgctggagtccctgaccgccatggacccctccggcggcggctacggctcccagttccagcacctgctgcgcctggaggacggcggcgagatcgtgaagggccgcaccgagtggcgccccaagaacggcgtgatcaacggcgtggtgcccaccggcgagtcctcccccggcgactactccatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagctgtagagctcggcggcgtgcgcaagatgaaccccttttgcatccccttctccatctccaacatgggcggcgcgatgctggcgatggacatcggcttcatgggccccaactactccatctccacggcctgcgcgacgggcaactactgcatcctgggcgcggcggaccacatccggcgcggcgacgcaaacgtgatgctggccggcggcgcggacgcggccatcatcccctcgggcatcggcggcttcatcgcgtgcaaggcgctgagcaagcgcaacgacgagcccgagcgcgcgagccggccctgggacgccgaccgcgacggcttcgtcatgggcgagggcgccggcgtgctggtgctggaggagctggagcacgccaagcgccgcggcgcgaccattttggctgaattagttggcggcgcggccacctcggacgcgcaccacatgaccgagcccgacccgcagggccgcggcgtgcgcctctgcctcgagcgcgcgctcgagcgcgcgcgcctcgcgcccgagcgcgtcggctacgtcaacgcgcacggcaccagcacgcccgcgggcgacgtggccgagtaccgcgccatccgcgccgtcatcccgcaggactcactacgcatcaactccacaaagtccatgatcgggcacctgctcggcggcgccggcgcggtcgaggccgtggccgccatccaggccctgcgcaccggctggctccaccccaacttgaacctcgagaaccccgcgcctggcgtcgaccccgtcgtgctcgtggggaagagcctctagatcttaaaatgaagtgaagttcctatactttctagagaataggaacttctatagtgagtcgaataagggcgacacaaaatttattctaaatgcataataaatactgataacatcttatagtttgtattatattttgtattatcgttgacatgtataattttgatatcaaaaactgattttccctttattattttcgagatttattttcttaattctctttaacaaactagaaatattgtatatacaaaaaatcataaataatagatgaatagtttaattataggtgttcatcaatcgaaaaagcaacgtatcttatttaaagtgcgttgcttttttctcatttataaggttaaataattctcatatatcaagcaaagtgacaggcgcccttaaatattctgacaaatgctctttccctaaactccccccataaaaaaacccgccgaagcgggtttttacgttatttgcggattaacgattactcgttatcagaaccgcccagggggcccgagcttaagactggccgtcgttttacaacacagaaagagtttgtagaaacgcaaaaaggccatccgtcaggggccttctgcttagtttgatgcctggcagttccctactctcgccttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagcttgcgccgtcccgtcaagtcagcgtaatgctctgcttt

SEQ ID NO: 250 - DNA, 9362 bp, Artificial Sequence
  synthesized construct
cactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgatgcatgctcttcgggctggtctgaatccttcaggcgggtgttacccgagaaagaaagggtgccgatttcaaagcagacccatgtgccgggccctgtggcctgtgttggcgcctatgtagtcaccccccctcacccaattgtcgccagtttgcgcactccataaactcaaaacagcagcttctgagctgcgctgttcaagaacacctctggggtttgctcacccgcgaggtcgacgcccagcatggctatcaagacgaacaggcagcctgtggagaagcctccgttcacgatcgggacgctgcgcaaggccatccccgcgcactgtttcgagcgctcggcgcttcgtagcagcatgtacctggcctttgacatcgcggtcatgtccctgctctacgtcgcgtcgacgtacatcgaccctgcaccggtgcctacgtgggtcaagtacggcatcatgtggccgctctactggttcttccaggtgtgtttgagggttttggttgcccgtattgaggtcctggtggcgcgcatggaggagaaggcgcctgtcccgctgacccccccggctaccctcccggcaccttccagggcgccttcggcacgggtgtctgggtgtgcgcgcacgagtgcggccaccaggccttttcctccagccaggccatcaacgacggcgtgggcctggtgttccacagcctgctgctggtgccctactactcctggaagcactcgcaccgggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaactctagaatatcaatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagaactcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggccaccgcatccactttctcggcgttcaatgcccgctgcggcgacctgcgtcgctcggcgggctccgggccccggcgcccagcgaggcccctccccgtgcgcgggcgcgccgccaccggcgagcagccctccggcgtggcctccctgcgcgaggccgacaaggagaagtccctgggcaaccgcctgcgcctgggctccctgaccgaggacggcctgtcctacaaggagaagttcgtgatccgctgctacgaggtgggcatcaacaagaccgccaccatcgagaccatcgccaacctgctgcaggaggtgggcggcaaccacgcccagggcgtgggcttctccaccgacggcttcgccaccaccaccaccatgcgcaagctgcacctgatctgggtgaccgcccgcatgcacatcgagatctaccgctaccccgcctggtccgacgtgatcgagatcgagacctgggtgcagggcgagggcaaggtgggcacccgccgcgactggatcctgaaggactacgccaacggcgaggtgatcggccgcgccacctccaagtgggtgatgatgaacgaggacacccgccgcctgcagaaggtgtccgacgacgtgcgcgaggagtacctggtgttctgcccccgcaccctgcgcctggccttccccgaggagaacaacaactccatgaagaagatccccaagctggaggaccccgccgagtactcccgcctgggcctggtgccccgccgctccgacctggacatgaacaagcacgtgaacaacgtgacctacatcggctgggccctggagtccatcccccccgagatcatcgacacccacgagctgcaggccatcaccctggactaccgccgcgagtgccagcgcgacgacatcgtggactccctgacctcccgcgagcccctgggcaacgccgccggcgtgaagttcaaggagatcaacggctccgtgtcccccaagaaggacgagcaggacctgtcccgcttcatgcacctgctgcgctccgccggctccggcctggagatcaaccgctgccgcaccgagtggcgcaagaagcccgccaagcgcatggactacaaggaccacgacggcgactacaaggaccacgacatcgactacaaggacgacgacgacaagtgaatcgatagatctcttaaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttaattaagagctcccgccaccactccaacacggggtgcctggacaaggacgaggtgtttgtgccgccgcaccgcgcagtggcgcacgagggcctggagtgggaggagtggctgcccatccgcatgggcaaggtgctggtcaccctgaccctgggctggccgctgtacctcatgttcaacgtcgcctcgcggccgtacccgcgcttcgccaaccactttgacccgtggtcgcccatcttcagcaagcgcgagcgcatcgaggtggtcatctccgacctggcgctggtggcggtgctcagcgggctcagcgtgctgggccgcaccatgggctgggcctggctggtcaagacctacgtggtgccctacctgatcgtgaacatgtggctcgtgctcatcacgctgctccagcacacgcacccggcgctgccgcactacttcgagaaggactgggactggctgcgcggcgccatggccaccgtggaccgctccatgggcccgcccttcatggacaacatcctgcaccacatctccgacacccacgtgctgcaccacctcttcagcaccatcccgcactaccacgccgaggaggcctccgccgccatcaggcccatcctgggcaagtactaccagtccgacagccgctgggtcggccgcgccctgtgggaggactggcgcgactgccgctacgtcgtcccggacgcgcccgaggacgactccgcgctctggttccacaagtgagtgagtgagaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgc

SEQ ID NO: 251 - DNA, 612 bp, Artificial Sequence
  synthesized construct
gctcttcggagtcactgtgccactgagttcgactggtagctgaatggagtcgctgctccactaaacgaattgtcagcaccgccagccggccgaggacccgagtcatagcgagggtagtagcgcgccatggcaccgaccagcctgcttgccagtactggcgtctcttccgcttctctgtggtcctctgcgcgctccagcgcgtgcgcttttccggtggatcatgcggtccgtggcgcaccgcagcggccgctgcccatgcagcgccgctgcttccgaacagtggcggtcagggccgcacccgcggtagccgtccgtccggaacccgcccaagagttttgggagcagcttgagccctgcaagatggcggaggacaagcgcatcttcctggaggagcaccggtgcgtggaggtccggggctgaccggccgtcgcattcaacgtaatcaatcgcatgatgatcagaggacacgaagtcttggtggcggtggccagaaacactgtccattgcaagggcatagggatgcgttccttcacctctcatttctcatttctgaatccctccctgctcactctttctcctcctccttcccgttcacgcagcattcggggtacc

SEQ ID NO: 252 - DNA, 528 bp, Artificial Sequence
  synthesized construct
gacagggtggttggctggatggggaaacgctggtcgcgggattcgatcctgctgcttatatcctccctggaagcacacccacgactctgaagaagaaaacgtgcacacacacaacccaaccggccgaatatttgcttccttatcccgggtccaagagagactgcgatgcccccctcaatcagcatcctcctccctgccgcttcaatcttccctgcttgcctgcgcccgcggtgcgccgtctgcccgcccagtcagtcactcctgcacaggccccttgtgcgcagtgctcctgtaccctttaccgctccttccattctgcgaggccccctattgaatgtattcgttgcctgtgtggccaagcgggctgctgggcgcgccgccgtcgggcagtgctcggcgactttggcggaagccgattgttcttctgtaagccacgcgcttgctgctttgggaagagaagggggggggtactgaatggatgaggaggagaaggaggggtattggtattatctgagttgggtgaagagc

SEQ ID NO: 253 - DNA, 3499 bp, Artificial Sequence
  synthesized construct
gctcttcggagtcactgtgccactgagttcgactggtagctgaatggagtcgctgctccactaaacgaattgtcagcaccgccagccggccgaggacccgagtcatagcgagggtagtagcgcgccatggcaccgaccagcctgcttgccagtactggcgtctcttccgcttctctgtggtcctctgcgcgctccagcgcgtgcgcttttccggtggatcatgcggtccgtggcgcaccgcagcggccgctgcccatgcagcgccgctgcttccgaacagtggcggtcagggccgcacccgcggtagccgtccgtccggaacccgcccaagagttttgggagcagcttgagccctgcaagatggcggaggacaagcgcatcttcctggaggagcaccggtgcgtggaggtccggggctgaccggccgtcgcattcaacgtaatcaatcgcatgatgatcagaggacacgaagtcttggtggcggtggccagaaacactgtccattgcaagggcatagggatgcgttccttcacctctcatttctcatttctgaatccctccctgctcactctttctcctcctccttcccgttcacgcagcattcggggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcgtagagctcactagtatcgatttcgaagacagggtggttggctggatggggaaacgctggtcgcgggattcgatcctgctgcttatatcctccctggaagcacacccacgactctgaagaagaaaacgtgcacacacacaacccaaccggccgaatatttgcttccttatcccgggtccaagagagactgcgatgcccccctcaatcagcatcctcctccctgccgcttcaatcttccctgcttgcctgcgcccgcggtgcgccgtctgcccgcccagtcagtcactcctgcacaggccccttgtgcgcagtgctcctgtaccctttaccgctccttccattctgcgaggccccctattgaatgtattcgttgcctgtgtggccaagcgggctgctgggcgcgccgccgtcgggcagtgctcggcgactttggcggaagccgattgttcttctgtaagccacgcgcttgctgctttgggaagagaagggggggggtactgaatggatgaggaggagaaggaggggtattggtattatctgagttgggtgaagagc

SEQ ID NO: 254 - DNA, 6514 bp, Artificial Sequence
  synthetic construct
gctcttcggagtcactgtgccactgagttcgactggtagctgaatggagtcgctgctccactaaacgaattgtcagcaccgccagccggccgaggacccgagtcatagcgagggtagtagcgcgccatggcaccgaccagcctgcttgccagtactggcgtctcttccgcttctctgtggtcctctgcgcgctccagcgcgtgcgcttttccggtggatcatgcggtccgtggcgcaccgcagcggccgctgcccatgcagcgccgctgcttccgaacagtggcggtcagggccgcacccgcggtagccgtccgtccggaacccgcccaagagttttgggagcagcttgagccctgcaagatggcggaggacaagcgcatcttcctggaggagcaccggtgcgtggaggtccggggctgaccggccgtcgcattcaacgtaatcaatcgcatgatgatcagaggacacgaagtcttggtggcggtggccagaaacactgtccattgcaagggcatagggatgcgttccttcacctctcatttctcatttctgaatccctccctgctcactctttctcctcctccttcccgttcacgcagcattcggggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggtggtggccgccgccgccagcagcgccttcttccccgtgcccgccccccgccccacccccaagcccggcaagttcggcaactggcccagcagcctgagccagcccttcaagcccaagagcaaccccaacggccgcttccaggtgaaggccaacgtgagcccccacgggcgcgcccccaaggccaacggcagcgccgtgagcctgaagtccggcagcctgaacaccctggaggacccccccagcagcccccccccccgcaccttcctgaaccagctgcccgactggagccgcctgcgcaccgccatcaccaccgtgttcgtggccgccgagaagcagttcacccgcctggaccgcaagagcaagcgccccgacatgctggtggactggttcggcagcgagaccatcgtgcaggacggcctggtgttccgcgagcgcttcagcatccgcagctacgagatcggcgccgaccgcaccgccagcatcgagaccctgatgaaccacctgcaggacaccagcctgaaccactgcaagagcgtgggcctgctgaacgacggcttcggccgcacccccgagatgtgcacccgcgacctgatctgggtgctgaccaagatgcagatcgtggtgaaccgctaccccacctggggcgacaccgtggagatcaacagctggttcagccagagcggcaagatcggcatgggccgcgagtggctgatcagcgactgcaacaccggcgagatcctggtgcgcgccaccagcgcctgggccatgatgaaccagaagacccgccgcttcagcaagctgccctgcgaggtgcgccaggagatcgccccccacttcgtggacgccccccccgtgatcgaggacaacgaccgcaagctgcacaagttcgacgtgaagaccggcgacagcatctgcaagggcctgacccccggctggaacgacttcgacgtgaaccagcacgtgagcaacgtgaagtacatcggctggattctggagagcatgcccaccgaggtgctggagacccaggagctgtgcagcctgaccctggagtaccgccgcgagtgcggccgcgagagcgtggtggagagcgtgaccagcatgaaccccagcaaggtgggcgaccgcagccagtaccagcacctgctgcgcctggaggacggcgccgacatcatgaagggccgcaccgagtggcgccccaagaacgccggcaccaaccgcgccatcagcacctgattaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcttgttttccagaaggagttgctccttgagcctttcattctcagcctcgataacctccaaagccgctctaattgtggagggggttcgaagacagggtggttggctggatggggaaacgctggtcgcgggattcgatcctgctgcttatatcctccctggaagcacacccacgactctgaagaagaaaacgtgcacacacacaacccaaccggccgaatatttgcttccttatcccgggtccaagagagactgcgatgcccccctcaatcagcatcctcctccctgccgcttcaatcttccctgcttgcctgcgcccgcggtgcgccgtctgcccgcccagtcagtcactcctgcacaggccccttgtgcgcagtgctcctgtaccctttaccgctccttccattctgcgaggccccctattgaatgtattcgttgcctgtgtggccaagcgggctgctgggcgcgccgccgtcgggcagtgctcggcgactttggcggaagccgattgttcttctgtaagccacgcgcttgctgctttgggaagagaagggggggggtactgaatggatgaggaggagaaggaggggtattggtattatctgagttgggtgaagagc

SEQ ID NO: 255 - DNA, 767 bp, Artificial Sequence
  synthesized construct
atggcaccgaccagcctgcttgccagtactggcgtctcttccgcttctctgtggtcctctgcgcgctccagcgcgtgcgcttttccggtggatcatgcggtccgtggcgcaccgcagcggccgctgcccatgcagcgccgctgcttccgaacagtggcggtcagggccgcacccgcggtagccgtccgtccggaacccgcccaagagttttgggagcagcttgagccctgcaagatggcggaggacaagcgcatcttcctggaggagcaccggtgcgtggaggtccggggctgaccggccgtcgcattcaacgtaatcaatcgcatgatgatcagaggacacgaagtcttggtggcggtggccagaaacactgtccattgcaagggcatagggatgcgttccttcacctctcatttctcatttctgaatccctccctgctcactctttctcctcctccttcccgttcacgcagcattcggggcaacgaggtgggcccgtgctcctccaggaagatgcgcttgtcctccgccatcttgcagggctcaagctgctcccaaaactcttgggcgggttccggacggacggctaccgcgggtgcggccctgaccgccactgttcggaagcagcggcgctgcatgggcagcggccgctgcggtgcgccacggaccgcatgatccaccggaaaagcgcacgcgctggagcgcgcagaggaccacagagaagcggaagagacgccagtactggcaagcaggctggtcggtgccat

SEQ ID NO: 256 - DNA, 9426 bp, Artificial Sequence
  synthesized construct
cactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgatgcatgctcttcgccgccgccactcctgctcgagcgcgcccgcgcgtgcgccgccagcgccttggccttttcgccgcgctcgtgcgcgtcgctgatgtccatcaccaggtccatgaggtctgccttgcgccggctgagccactgcttcgtccgggcggccaagaggagcatgagggaggactcctggtccagggtcctgacgtggtcgcggctctgggagcgggccagcatcatctggctctgccgcaccgaggccgcctccaactggtcctccagcagccgcagtcgccgccgaccctggcagaggaagacaggtgaggggggtatgaattgtacagaacaaccacgagccttgtctaggcagaatccctaccagtcatggctttacctggatgacggcctgcgaacagctgtccagcgaccctcgctgccgccgcttctcccgcacgcttctttccagcaccgtgatggcgcgagccagcgccgcacgctggcgctgcgcttcgccgatctgaggacagtcggggaactctgatcagtctaaacccccttgcgcgttagtgttgccatcctttgcagaccggtgagagccgacttgttgtgcgccaccccccacaccacctcctcccagaccaattctgtcacctttttggcgaaggcatcggcctcggcctgcagagaggacagcagtgcccagccgctgggggttggcggatgcacgctcaggtaccctttcttgcgctatgacacttccagcaaaaggtagggcgggctgcgagacggcttcccggcgctgcatgcaacaccgatgatgcttcgaccccccgaagctccttcggggctgcatgggcgctccgatgccgctccagggcgagcgctgtttaaatagccaggcccccgattgcaaagacattatagcgagctaccaaagccatattcaaacacctagatcactaccacttctacacaggccactcgagcttgtgatcgcactccgctaagggggcgcctcttcctcttcgtttcagtcacaacccgcaaacggcgcgccatgctgctgcaggccttcctgttcctgctggccggcttcgccgccaagatcagcgcctccatgacgaacgagacgtccgaccgccccctggtgcacttcacccccaacaagggctggatgaacgaccccaacggcctgtggtacgacgagaaggacgccaagtggcacctgtacttccagtacaacccgaacgacaccgtctgggggacgcccttgttctggggccacgccacgtccgacgacctgaccaactgggaggaccagcccatcgccatcgccccgaagcgcaacgactccggcgccttctccggctccatggtggtggactacaacaacacctccggcttcttcaacgacaccatcgacccgcgccagcgctgcgtggccatctggacctacaacaccccggagtccgaggagcagtacatctcctacagcctggacggcggctacaccttcaccgagtaccagaagaaccccgtgctggccgccaactccacccagttccgcgacccgaaggtcttctggtacgagccctcccagaagtggatcatgaccgcggccaagtcccaggactacaagatcgagatctactcctccgacgacctgaagtcctggaagctggagtccgcgttcgccaacgagggcttcctcggctaccagtacgagtgccccggcctgatcgaggtccccaccgagcaggaccccagcaagtcctactgggtgatgttcatctccatcaaccccggcgccccggccggcggctccttcaaccagtacttcgtcggcagcttcaacggcacccacttcgaggccttcgacaaccagtcccgcgtggtggacttcggcaaggactactacgccctgcagaccttcttcaacaccgacccgacctacgggagcgccctgggcatcgcgtgggcctccaactgggagtactccgccttcgtgcccaccaacccctggcgctcctccatgtccctcgtgcgcaagttctccctcaacaccgagtaccaggccaacccggagacggagctgatcaacctgaaggccgagccgatcctgaacatcagcaacgccggcccctggagccggttcgccaccaacaccacgttgacgaaggccaacagctacaacgtcgacctgtccaacagcaccggcaccctggagttcgagctggtgtacgccgtcaacaccacccagacgatctccaagtccgtgttcgcggacctctccctctggttcaagggcctggaggaccccgaggagtacctccgcatgggcttcgaggtgtccgcgtcctccttcttcctggaccgcgggaacagcaaggtgaagttcgtgaaggagaacccctacttcaccaaccgcatgagcgtgaacaaccagcccttcaagagcgagaacgacctgtcctactacaaggtgtacggcttgctggaccagaacatcctggagctgtacttcaacgacggcgacgtcgtgtccaccaacacctacttcatgaccaccgggaacgccctgggctccgtgaacatgacgacgggggtggacaacctgttctacatcgacaagttccaggtgcgcgaggtcaagtgacaattggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaggatcccgcgtctcgaacagagcgcgcagaggaacgctgaaggtctcgcctctgtcgcacctcagcgcggcatacaccacaataaccacctgacgaatgcgcttggttcttcgtccattagcgaagcgtccggttcacacacgtgccacgttggcgaggtggcaggtgacaatgatcggtggagctgatggtcgaaacgttcacagcctagggatatcgaattcggccgacaggacgcgcgtcaaaggtgctggtcgtgtatgccctggccggcaggtcgttgctgctgctggttagtgattccgcaaccctgattttggcgtcttattttggcgtggcaaacgctggcgcccgcgagccgggccggcggcgatgcggtgccccacggctgccggaatccaagggaggcaagagcgcccgggtcagttgaagggctttacgcgcaaggtacagccgctcctgcaaggctgcgtggtggaattggacgtgcaggtcctgctgaagttcctccaccgcctcaccagcggacaaagcaccggtgtatcaggtccgtgtcatccactctaaagagctcgactacgacctactgatggccctagattcttcatcaaaaacgcctgagacacttgcccaggattgaaactccctgaagggaccaccaggggccctgagttgttccttccccccgtggcgagctgccagccaggctgtacctgtgatcgaggctggcgggaaaataggcttcgtgtgctcaggtcatgggaggtgcaggacagctcatgaaacgccaacaatcgcacaattcatgtcaagctaatcagctatttcctcttcacgagctgtaattgtcccaaaattctggtctaccgggggtgatccttcgtgtacgggcccttccctcaaccctaggtatgcgcgcatgcggtcgccgcgcaactcgcgcgagggccgagggtttgggacgggccgtcccgaaatgcagttgcacccggatgcgtggcaccttttttgcgataatttatgcaatggactgctctgcaaaattctggctctgtcgccaaccctaggatcagcggcgtaggatttcgtaatcattcgtcctgatggggagctaccgactaccctaatatcagcccgactgcctgacgccagcgtccacttttgtgcacacattccattcgtgcccaagacatttcattgtggtgcgaagcgtccccagttacgctcacctgtttcccgacctccttactgttctgtcgacagagcgggcccacaggccggtcgcagccactagtatggtggtggccgccgccgccagcagcgccttcttccccgtgcccgccccccgccccacccccaagcccggcaagttcggcaactggcccagcagcctgagccagcccttcaagcccaagagcaaccccaacggccgcttccaggtgaaggccaacgtgagcccccacgggcgcgcccccaaggccaacggcagcgccgtgagcctgaagtccggcagcctgaacaccctggaggacccccccagcagcccccccccccgcaccttcctgaaccagctgcccgactggagccgcctgcgcaccgccatcaccaccgtgttcgtggccgccgagaagcagttcacccgcctggaccgcaagagcaagcgccccgacatgctggtggactggttcggcagcgagaccatcgtgcaggacggcctggtgttccgcgagcgcttcagcatccgcagctacgagatcggcgccgaccgcaccgccagcatcgagaccctgatgaaccacctgcaggacaccagcctgaaccactgcaagagcgtgggcctgctgaacgacggcttcggccgcacccccgagatgtgcacccgcgacctgatctgggtgctgaccaagatgcagatcgtggtgaaccgctaccccacctggggcgacaccgtggagatcaacagctggttcagccagagcggcaagatcggcatgggccgcgagtggctgatcagcgactgcaacaccggcgagatcctggtgcgcgccaccagcgcctgggccatgatgaaccagaagacccgccgcttcagcaagctgccctgcgaggtgcgccaggagatcgccccccacttcgtggacgccccccccgtgatcgaggacaacgaccgcaagctgcacaagttcgacgtgaagaccggcgacagcatctgcaagggcctgacccccggctggaacgacttcgacgtgaaccagcacgtgagcaacgtgaagtacatcggctggattctggagagcatgcccaccgaggtgctggagacccaggagctgtgcagcctgaccctggagtaccgccgcgagtgcggccgcgagagcgtggtggagagcgtgaccagcatgaaccccagcaaggtgggcgaccgcagccagtaccagcacctgctgcgcctggaggacggcgccgacatcatgaagggccgcaccgagtggcgccccaagaacgccggcaccaaccgcgccatcagcacctgattaattaactcgaggcagcagcagctcggatagtatcgacacactctggacgctggtcgtgtgatggactgttgccgccacacttgctgccttgacctgtgaatatccctgccgcttttatcaaacagcctcagtgtgtttgatcttgtgtgtacgcgcttttgcgagttgctagctgcttgtgctatttgcgaataccacccccagcatccccttccctcgtttcatatcgcttgcatcccaaccgcaacttatctacgctgtcctgctatccctcagcgctgctcctgctcctgctcactgcccctcgcacagccttggtttgggctccgcctgtattctcctggtactgcaacctgtaaaccagcactgcaatgctgatgcacgggaagtagtgggatgggaacacaaatggaaagcttgagctcttgttttccagaaggagttgctccttgagcctttcattctcagcctcgataacctccaaagccgctctaattgtggagggggttcgaatttaaaagcttggaatgttggttcgtgcgtctggaacaagcccagacttgttgctcactgggaaaaggaccatcagctccaaaaaacttgccgctcaaaccgcgtacctctgctttcgcgcaatctgccctgttgaaatcgccaccacattcatattgtgacgcttgagcagtctgtaattgcctcagaatgtggaatcatctgccccctgtgcgagcccatgccaggcatgtcgcgggcgaggacacccgccactcgtacagcagaccattatgctacctcacaatagttcataacagtgaccatatttctcgaagctccccaacgagcacctccatgctctgagtggccaccccccggccctggtgcttgcggagggcaggtcaaccggcatggggctaccgaaatccccgaccggatcccaccacccccgcgatgggaagaatctctccccgggatgtgggcccaccaccagcacaacctgctggcccaggcgagcgtcaaaccataccacacaaatatccttggcatcggccctgaattccttctgccgctctgctacccggtgcttctgtccgaagcaggggttgctagggatcgctccgagtccgcaaacccttgtcgcgtggcggggcttgttcgagcttgaagagcctctagagtcgacctgcaggcatgcaagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgc

What is claimed is:

1. A method for producing an oil, the method comprising:
   (a) cultivating a microalga of the genus *Prototheca*, the microalga comprising a gene knockout of an endogenous FATA acyl-ACP thioesterase gene and wherein the microalga produces an oil enriched in oleic acid due to the gene knockout; and
   (b) obtaining the oil.

2. The method of claim 1, wherein the microalga is cultivated so as to comprise 50 to 90% triglyceride by dry cell weight.

3. The method of claim 1, wherein the oil produced is characterized by a fatty acid profile elevated in C18:1 fatty acids and reduced in C16 fatty acids as a result of the gene knockout.

4. The method of claim 1, wherein the microalga is of the species *Prototheca moriformis*.

5. The method of claim 1, wherein the microalga expresses an exogenous sucrose invertase so as to be cultivatable on sucrose as a sole carbon source.

6. A method for producing an oil, the method comprising:
   cultivating a microalga of the genus *Prototheca*, the microalga comprising a gene knockout of an endogenous FATA acyl-ACP thioesterase gene,
   wherein the microalga produces an oil enriched in oleic acid due to the gene knockout and the microalga comprises 50 to 90% triglyceride by dry cell weight, and
   wherein the oil produced is characterized by a fatty acid profile elevated in C18:1 fatty acids and reduced in C16 fatty acids as a result of the gene knockout; and
   obtaining the oil.

7. The method of claim 6, wherein the microalga further comprises recombinant nucleic acids encoding an active sucrose invertase so that the microalga can be cultivated on sucrose as a sole carbon source.

8. A method for producing an oil, the method comprising:
   (a) cultivating a microalga of the genus *Prototheca*, the microalga comprising an RNAi suppression construct, which targets and decreases production of an acyl-ACP thioesterase encoded by a FATA acyl-ACP thioesterase gene, and wherein the microalga produces an oil enriched in oleic acid due to the RNAi suppression construct; and
   (b) obtaining the oil.

9. The method of claim 8, wherein the microalga is cultivated so as to comprise 50 to 90% triglyceride by dry cell weight.

10. The method of claim 8, wherein expression of the RNAi suppression construct leads to formation of a hairpin RNA.

11. The method of claim 10, wherein the oil produced is characterized by a fatty acid profile elevated in C18:1 fatty acids and reduced in C16 fatty acids as a result of the RNAi suppression construct.

12. The method of claim 8, wherein the microalga is of the species Prototheca moriformis.

13. The method of claim 8, wherein the microalga expresses an exogenous sucrose invertase so as to be cultivatable on sucrose as a sole carbon source.

14. A method for producing an oil, the method comprising:
   (a) cultivating a microalga of the genus Prototheca, the microalga comprising a dsRNA suppression construct, which targets and decreases production of an acyl-ACP thioesterase encoded by a FATA acyl-ACP thioesterase gene, and wherein the microalga produces an oil enriched in oleic acid due to the dsRNA suppression construct; and
   (b) obtaining the oil.

15. The method of claim 14, wherein the microalga is cultivated so as to comprise 50 to 90% triglyceride by dry cell weight.

16. The method of claim 14, wherein the oil produced is characterized by a fatty acid profile elevated in C18:1 fatty acids and reduced in C16 fatty acids as a result of the dsRNA suppression construct.

17. The method of claim 14, wherein the microalga is of the species Prototheca moriformis.

18. The method of claim 14, wherein the microalga expresses an exogenous sucrose invertase so as to be cultivatable on sucrose as a sole carbon source.

19. A method for producing an oil, the method comprising:
   (a) cultivating a microalga of the genus Prototheca, the microalga comprising an anti-sense RNA suppression construct, which targets and decreases production of an acyl-ACP thioesterase encoded by a FATA acyl-ACP thioesterase gene, and wherein the microalga produces an oil enriched in oleic acid due to the anti-sense RNA suppression construct; and
   (b) obtaining the oil.

20. The method of claim 19, wherein the microalga is cultivated so as to comprise 50 to 90% triglyceride by dry cell weight.

21. The method of claim 19, wherein the oil produced is characterized by a fatty acid profile elevated in C18:1 fatty acids and reduced in C16 fatty acids as a result of the anti-sense RNA suppression construct.

22. The method of claim 19, wherein the microalga is of the species Prototheca moriformis.

23. The method of claim 19, wherein the microalga expresses an exogenous sucrose invertase so as to be cultivatable on sucrose as a sole carbon source.

24. A method for producing an oil, the method comprising:
cultivating a microalga of the genus Prototheca, the microalga comprising an RNAi suppression construct, which targets and decreases production of an acyl-ACP thioesterase encoded by a FATA acyl-ACP thioesterase gene,
wherein the microalga produces an oil enriched in oleic acid due to the RNAi suppression construct and the microalga comprises 50 to 90% triglyceride by dry cell weight, and
wherein the oil produced is characterized by a fatty acid profile elevated in C18:1 fatty acids and reduced in C16 fatty acids as a result of the RNAi suppression construct; and
obtaining the oil.

25. The method of claim 24, wherein the microalga further comprises recombinant nucleic acids encoding an active sucrose invertase so that the microalga can be cultivated on sucrose as a sole carbon source.

26. The method of claim 24, wherein expression of the RNAi suppression construct leads to formation of a hairpin RNA.

27. A method for producing an oil, the method comprising:
cultivating a microalga of the genus Prototheca, the microalga comprising a dsRNA suppression construct, which targets and decreases production of an acyl-ACP thioesterase encoded by a FATA acyl-ACP thioesterase gene,
wherein the microalga produces an oil enriched in oleic acid due to the dsRNA suppression construct and the microalga comprises 50 to 90% triglyceride by dry cell weight, and
wherein the oil produced is characterized by a fatty acid profile elevated in C18:1 fatty acids and reduced in C16 fatty acids as a result of the dsRNA suppression construct; and
obtaining the oil.

28. The method of claim 27, wherein the microalga further comprises recombinant nucleic acids encoding an active sucrose invertase so that the microalga can be cultivated on sucrose as a sole carbon source.

29. A method for producing an oil, the method comprising:
cultivating a microalga of the genus Prototheca, the microalga comprising an anti-sense RNA suppression construct, which targets and decreases production of an acyl-ACP thioesterase encoded by a FATA acyl-ACP thioesterase gene,
wherein the microalga produces an oil enriched in oleic acid due to the anti-sense RNA suppression construct and the microalga comprises 50 to 90% triglyceride by dry cell weight, and
wherein the oil produced is characterized by a fatty acid profile elevated in C18:1 fatty acids and reduced in C16 fatty acids as a result of the anti-sense RNA suppression construct; and
obtaining the oil.

30. The method of claim 29, wherein the microalga further comprises recombinant nucleic acids encoding an active sucrose invertase so that the microalga can be cultivated on sucrose as a sole carbon source.

* * * * *